United States Patent 9,567,581 (SELECTIVE REACTIVATION OF GENES ON THE INACTIVE X CHROMOSOME) - sequence listing, part 39

SEQ ID NO: 4462 - DNA, 2092328 bp, human
tcctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttgtaagtacaaagtaactaaaaatatattttactgtggcataacgtttagtttgtgacaagctcactaattaggtagattgattttaaattatcacagtagtttgcaaagaagcataaatgttatatatactgcatatatatatgtatttattcaggaatatatatttttcattgggaaaacttttcaacagaaatggagtgtaaaagtttttctttgcgatagaactaaacacatgatttcttgattaacaaaccactgcagtaatagaatatgcagaatgtcatttgactataacagatttattttgattgctgtgagatagtttgtatatctgagttattattttgattagttgatacttccgtatttagtaacagttacataaaggttactgacctgacatatattctcaattgaactaactactgtataggaactacatggaggcctaaaagttagaaaaagtttctctgacacatcatggataaaataaagaataaaatgagttgggacggataattgaaggatgtgaaaagtattgataaagatttaattttaatgtttcttactcacatttactatttcaaatgctcttttctgtagcatatcatgataattatttcaaataatgatgtgatctatgctatcaaatgatcagatgatttcttgggtaaacgacatacaaacttgaggaactcctaattatatttagtagtaaagtcaccttgttgtttcatgtctattatgagccagcttttcagttcaattttttagtttgtctttcatatagaaatacaactatttcgtttatttttaagaaagtcatgatgactaatgaaggatttaaaaatggactgtggcacaacagtaaaaataatatatgataaggactgtgtgtcccgaagagatgggagtttatctcttccccacccatctttgacttgtggagtgtagttattctaaaatagatatgagggcaatgcctataattaagaatgaaaaaataaatctctccaaataagtaatgctccacaactactaaaaaaaaaggcagaagttttgccactgggaaaactttgtggaaataagttaacattgtccatgtattgagtcacattaaaagctaccagactttataatacaatatttacttacattgttggcttgcttcataaatttcttttggtggacatcattattacttttagattgaaaaactattatatttactatcattacaaatatatgcatggcatatatctgttgtttgcaatatacacacacatttttattttttgtttttatttctttgatatatgtaacataaataccatcaaaatcactagtgattttatatatatatatattctacataattaacatcatatacaagtatatagagcaattttgaaagaatatatgcaattctgctgaaattaagcaaggtaaatctacactctgctttgtcatagatattcaaataactttcaattcttagaatgcgaagaaaggtaatctttttgggacatgccctgtaggattttttcacgctgcatttaaaaaatcatcaagtaatgcctatgcaacatgacaatgagtttggtaagaaaaaacggagatatactcagggctatattatacattaaattttgctgtttgacaacatactgctacttggatgtttgacatttgaatccagtttgtaaatttgccgtagtttgataaacttacaaaagtacgttttgttgttttttaaccaaaacagttaccctttaaaagagatcactgtattgtcaaacatattgtattgttcacttttagaattactcaaataatgcattgtaaagaattattcaaatagtgtactgcaaatagacatttcatttgaatatatttaaatgatgtaagtcatctgaggtctaataaaatcaccttttagaatttcatctgcagaatcttttaaagacatcttaactacgaaaaagagattgctgatctaaattgatgatatactgttaatacaaagcttttggtgtatcttacatgacataacattatgaaaaatacaatagagtatgtcatatagatgttactctaaactttaaaaaaagactacaaagtgttctatgcataattacattatttaaggggaaaaaggtgttggctgacactattccagctagacagtactgaattgcaaattcatcatttgggcacagatattaatacagcttcctctttattcctatagcattcatttgaaatccctgtactccatgtcatttgctacatatgaaacaaattgtcaagtttttaaccacttgtgtagtttaataaaagagattaaaatcattgtcttggaaacatcaggtgtttttcaaaattctattttattatctttcatcaaaattttatctcaagagtaaaacaaagtcatttcccaaactttccttctccttccaccttctattgtaatattttcctaacttattaaaaatgatttatcatactttttcatcaactctttatttcatcacacatacaagaaacacagtattttggtatgagtatatatatttatatatatgcacatttatatgcattcaaatcacagggtataaagtttcctaagagggtctaattagaaattaacctttctttaaagataattttctgttcatttttctaaattttctattttaaacacacatcattttttaaggaattgacaaatgagactaatgtacattccctgtctgacaacacagaacgaaccaggaagaaaggatttatggggcctgaggttatacaattgggggtgctattttaagaaaaataatagaaaattggatacagccttgggaggggcccctcatgtaagtaaggctttaatagtttcttgggaaatcacctctgtatgaagagatgtgttgacatttaatcttttcccagttacattttaaaataaaattgatgctagttatatttctttagagcatttattatttctcaaagacaaccttttatttaatgcagattagagagttaaaagaatttataatggtaggaatttgacatttctgcctttcattctgaaaagatacattgattaaagtgatgtcaaactcagttaatggaggcggtgcagttatttgaaatatacagggtatataatttgaaggcacgccaaatcacaatgacaaggaataatgatgaccttggtttatttttatacagtacattcaggttttgattggattcagagagaggcaatggttttctttctcacaaagtcctgctatagtcctaggaggtttgtgttctgttatcaaggcagttggttcgtattggaatattttctggggaaggtcatgggctgcagtgtgggaaataaacgtttttattaaatgcaaccaggtttcatgaaaatatttccccttgtagagtgtgctcaatgcagtatactgatcttcaaaaaacaaacaaaccaagcaaataaatagtttgtagtcttcaccttttccctacgtaaaacatctattagttagacttccttggggtttcatgctataaaatattgacatatgtttggagttctgaagtttcattttaatacagatatcaaagttaaaatggcaacaccatgggataatttattattttaccaagtttggagggttttttctatttatgtcacttatagaattgtccctaaaatccttgcaaaatttcaagctccctctacttaatactaaaagtgaatgtgtcttccagagattctgataaccccttcgaatgggagagtaactctgctatttgtgaatcactcctatactaaatatagttccaagattaaaagctaaaatgattttgtttattttttcatgaaattttttcatgaaaggcttgatagtataaaaagtctgtttccctcatatattacagcatattatagcattcaatgtgccttcttaaaccagatggctcctctagagattatgaaatactttaacacccagggcatagcctttctgtttccccattcaagattacttccttgaatatggcccaacaaaaagaccaaaaaaatacatttggctccagcgttttaagggcatataaattttcttaagcacaattctgataggcagcagacaaatgagaatgaggaagggaaatggctctgctgtcttatgcttaaaagtgtcctcatatagagagaaacaacacaccctggggcctttcggagggtagagggttggaggaggaagaggatcaggaaaagcaactaatgggtactaggcttgatacctgggtgatgaaataatctgtacagcaaacccctatggcacaagtttacctatgtaacaaacctgcacttgtagccctgaacttaaaagttaaaaaaaaataaaataaaaagagtcctcatctcacggccatacaacctctacctcattcccattaaaaacacaaagatcagtactccctcttttatagctcacatcttctgtttaggctgccattttaagggataatttctattcaactctgagctcgatctttattttaatctgatatcactcgttcaaaatacttgggaatttcagtaggcaacggaacacacagagcaattttctggaggcctacaacctctgaaggtgactttgcgtagtatatgtaatgatagtaagccctgagaaaaccaatgttcttagtagtctggatttggtttagaaatcaatgtattcctgctttcttttgtgatcttttgccttctccctcaatgcctcactttcactctgtcattatgaaccccattcctcactaatgggaactgggggagaatggacaatgatcctttaattgaaatggagttgtcatttccttgccatgctgataaaatgttgttgctgttgttgtttgttgttgttcttaaatgactctttcagaatttttaactcagtattttgattacataccattttaagaaaataattgtccataaattaaaaatgctagcaaattgatgaattgattttctcatgccaatttggaaatctgaaatatatctaagactggtgaataatatgtaggtctaattgccatttgaataaaagaatctgaggaagagctttgcctttatttttgtttattattcattttagtttagttatttattttagtagaaaaatgtggttgtgtcaacgaagaggaggtacattaaaatgcattattaaagccaatgcttatccatgtaatgaaatgagaatgtagatggcttaatgggttttggagaggattaagataattttaaagaaacttcaaaaaatcagatgctcgaatcatgatgttttttgtttatatttaataaatatgaaaaccatacatgggcatatcaacaatgaggaattcacatatatatcacgaagtctcttgctaatttgtcaacttttaaatgtgttgtcttcactatcatgaaaattttgatttttaaaaaaggtcagtgttagctgagcacaattaccattacggtgtcccatattatttccaattatgggcaaataaaatgcttaccctttaaatgtttttaccctcttcttggcttttgttttgttttgttttaaagcgttctcccttcttccactctgcttttggctaagactgtcatggaatcaggactataaaagggcataaacatcagtagcttttttctcattcctggcactcatctttatttgcactcaacttgtctcttcctttatcagattacggttgcaatagtaccttagcctgagctaagtgctgacttaaagggcaagggagtcagtacactgttacaagtgcagattttagccttggaagctgtgtgaggaaaaattaaagaaataagaaagaaaaatcacaaaatcagaatggcccacgtattttcatcaaaggcaaattgagtaattcctttttatgttggtgcttaagaacgatgtattagaaataaattggtgactaagtgaacaaaatattaataaactagttgagtaagtgaaaaaataataatctgtaaaaatgatgaatcccaatgactcacatgttgcaaaataactaggaagcaaaagggaaattagactttaaagagcgtaatcagatgcaagaaatgttggcttgtaggtggttaactaaaatcgcttacgggaagctcagacagctggggaatcctgatttagtagacgctgaagggcagggcatgagccatgtgaacagctgctgaagagctagaggattcctttggattaggtgtacacaccccgtctctaatgggctgtcagagagcaccaagtgttatcacagaggttcactttgctcaagcctatggcttttgcagtgttttactttaaatgtctgaaaatggattggctctcaaaataaatccaaaaataaaagtatcaaaataagtgactctctaaaacttgtattgtgtggttttgggtgaccacagtttaaagaagggacttacagctgatgatttgttatccatttattgattcatttgtccatgtaacaaatacacatattgagtgcccattttgtgccaggtactgtgctatgctctggcgatagtattctaaacaagtgaactcaaagagagactagcatttcaaggaggatgtgcatattaaatacacacacacgcaaactacttgcattggagataagggctatagaataaagcacacattgtaataagaatgtataatagggagagttagaccagtcttcgaaattggggaaatacttctgagaaaaaaaaaatattcaaagcaaggcaaagaagaatgaggttagagtatagttgtccaaaagaaaagagggagcaaaaatgtccctgtcagagggagcaatgtttctgaatgtggaaaatggtatggagaaagatctaaaacaagtacagctttcctagagtacagtgagggcagaaaagtgtggaacaagcttgcatctgaatggccgactggggtccaatcattcagagccttgaaggttatagaaattatttttctctttatactaagatcaatggacagccttatgggtttcaggtagaaaactgatgtaaacatatttgtattttttaagactatcactctgttttgtgtgaaagagattggcaagtgcctagggtagatgaaggactatcaatctgaagcaattacggtagctcatccaaaagaaggtgatttggactagaatggggacagtggagatgaaagaagtaaatctattcaagatttgtatatgagatagaatcaataggaattggtgttgtattgcatgctgtgtgctccatgaaatgcacacctgggtggataatggtgccatttgcaaggagattggaagggaaattggaacaacaggaaggattaggggtgtggatgctaaggtgtttgttttgttttgtatttttatgtagcgcgtgggtattgtgcctagaaatgaagtcattattagggatttaaatatgcaactcatggagtggatgagaccagctagaaagataatagagtgtgaagaggagatcggaaattcaataaagaagacaaaagcactaaaaaaaaaaaatcagagaagacacatctagaaaaaatgatgaaattctaaggaaaataatatttccataaagaggtctgttcctttcgatctccaatttaatgacttcatgaatgaggatcccacttttagcattaggtgtcttggtttccacagtctctaccatctatttacccctaatttcctcccatattgctatttctgtgaatattaccaaaatgttgccttagtagaaaagcttcaataaatatttaaattgtataacgtattcagctttttcctgtactctgcacttcctaaaaataccttcttcggaaaccccatttcaactgactactgtataatgaaatgagccttcagtgtaaaacatttatcatagtctcaatttcaattgctcagtcagaattgttgagtaatatgaaaaatcatcctttagagaatacagaattgcatagttatgacaaggtaagtttgcactttatttaatgctagtttagttaatatagatgcttattggagaaatgtctaaaaattctggaggaccgttagtgaaagtgattatcccaatatctgcaaaaatggtaaaaatacctagaaaacattgacatttcagtttaaataaagccagaatcacaataaagagatagaaggcatttgagtaattcaatctaatcatggatgaatgtaatgtacttatcagttagctttggaggaagtaagactcgatagaatagtaatatgatattgagcaactttttttaacattaggtttttaattgcttataactcaacattgttgaacacctatgttctctttgctttttatgagacagcaactctaagtcagagaacagatacacacacatatgtatatgcgtacaactactataaaatatcaagaaagttataaagcatggtacaaatcaatcataaatgattacttatgaatagtgtgattatggacattctcattgaagaatccatttttataaataggcataagagtatggacatacagagatgtgaattagagaatgattgcaagaagcagtgaggcaaaaaggattaatgaaacattgatctgtcttacatacacagctattgacagtaccttgtgtgtgcatagcactattctagattcacctaatcttcaatgataatactgtatttaccatttaacaagcctgtaataagtgtcaggcacttctctgattacatcacatacatatgtgataagttccatattaactctagaaggtggggaaacataatcatctaaatttaccagatgaatatgtagaggtacagggagattaagtaatttgcttaaggtagctcagctggtacgtggtagagtcaggattttaatggtggcagcatgacagtaggattaaagattcttaaccagtcagttgtcacgatctctcagattttaatagaattctaaaaaggatagaacaaaatataaaatggcaggaatcatagtatcttctaacaagaactagacatgtcccattgaggatgctctttaaaaataaaacccattaaaattttgggttgtttactcaaagcctatagacattggcatattatattttcttagataaaaactgagatatcctaaataactcatgcccattctctagacttgcatagggagctgtctatgataatatccataacagttatcttgtttcacaattttattactatctcactcttcttactttgtgaagatgaaaaagatcaaaaataaaactaatgcagccctggtttgtttgtaatcatctacagttagccatccttagagtggtctcactagttgttcttttagagtttatttcagttatgtacaggcaactgtgctacatgaacaaaaagctaagaactgggctaacctgaacatgatttagtattgtaaaaaaatggtttacatagattaacgtgccatactattctgaatagtacttggcataaacagtaggttatttaagttactataattactgttgcctttttacataaactaatttttctcttatcttcattatgttagtcatccacagtgtgatatttagttgcatacattcatatagtgtacactgtacaattctagagtgtaccagtaacgtggactattaatattatgctatgaggtaaatgacacccctggagttaagcaatgtgcactctgtacgataacgtcaacattggcattctcatatatatgattagaaataatactgagtttctctgacttcacaagcaattttattctctcatctcataaagaggtaatgaatgcacacatatctacatatttaaaaataatgtcagagatcgtgatggaacagaattattcaagatgtataaatgagggtgggaggcaaagggaagtcagaaatactccccaataatttatttcaaattaaaagcctattggttattggctggtcgcggtggctcatgcctgtaatcccaacactttgggaggccaaggcgggcagatcacctgaggtcaggaattccagaccagcctggccaacatggtgaaaccacatctctactaaaatacaaaaattagccagacgtggtggcgtgcacctgtaatcccagctactcaggaggctgtggcaggagaatcacttgagcccgggaggtggaagttgcagtgagcggagatctcgccactgtactccagcctgggtgaaagagtgagactctgtctcaaaaaaaaaaaaaaaaaaaaaaaagtctattgattatcatgtgcgtttccatggtatcaattgtttagtattgtccagtaactaactagtatataaaactatcaggataatataaattttaacatttatttaaaatgcatcttcttaactgtaaggttattgatctttggataagctatagaaataagccttaattcagaaatatatttcggagacccagtaggttaatttgtagcactactctttaatattaaatatacaaatatacattgtttttataacttactgctataatgacactaagatgtgtgattatataaaaataagaaattgttagaatttattttattttaatcaatgctgatccatttttctagtgtatgagattagatgaggttgtatgagataccacttttctaggaaaaaagaaagtctttatgacagtgtgatgaatgaagtaaattagctcatttctttcaatattactagtgtgcatagatcttctctttttgtctttctgtctatcatacatacacagaggcacacatacatacacattacttggaaattaagtggtttacgtatgaaagtttttggctttactgataagatcagtaacatgataaataatacaacactgaatacatttttccatttgaaaagtgtaaagaacactacaacacggttgggaaaaaaaaacaacttattatattcaaatgtcattcccaattgtaacaaacatataattatttatttcttaattaagaagctattaataatagtactttaatattcaacattagcagtaactttgttggtttcttttttgataatttgtttaagaaaattagattataaattctgttatggtaaaaatacaaaaataaagcaaagtattatcttctttctatctcttatatgcatcagttggacaagatattgagattctcttttcttttaattgcatgctttcattatttttctattcaagcttcaccctgctaagttcaagtgaagtagaggacttcatgtctctagaaccaattaatgaaatttcttcgtctttcttgaacttgcagaaggtcaatagtgaccattttctcccttcttaaaaatgttgtcgtctttaagatctgtgcactgtcctctcatggcttcactactactttggagggtgtttgtattcagtctgcattgcaggctgatcctctcttctcagcctttaaaaattaggtttccttgggatctagtcctagcataattctcttctcataatgatctcttcctcgatcattgcacttatgtccacagctttattaacacttatatacagataactaaccaagttatacctctagcttagatttctccaatgaattccagaactgtgatttcaactgcctgggtggcatctccattcttatgtgatagtcacctccctctaaatgccctaaacagaactttctcttcaccgcacaaaacctgcttccttctcattgtttttcttatcattgaatggtgcaaccattcacccagtttcacaagccagaaacatatctcatccttgaaactctgatcttttttacccagttatttctaagtcattgccagtcactgtgggttttatcctctaatatattttcatccacttctctttatctcctctaccatcatcctagcgcaatatattttctctcactaggaatacagcagcctttcctttccagtttctctgcattctctttcgtattcttgataatccactctctaaacttcatgcagccaattaaattcgaagataccaccacttgttaaatcatgttagtagtttctcttggttgctaggaaagccaaacaaaacaaaacaaaacacatttaaaaatcaaagtctagacactgcctacctctcctatctcatttcccatcatgtttcctttgcctcgcccccttactggctttctttttgttccctgactaggtatagctttttttttttatctacagtacttttgtgtatgcttttctatttgtctagaacctccccgtttccccttttttaccttgatgacaccattttccacctacaagcttacctctggatagacatcaaaatcccctaagtacatcaaattcctctaccacgtaacatctgttcataacacatagcactgttatgattccatatgtatgtacgtgactaattaatacttgccagtcggattatgtggtaagttctatgaaccaagacacctcaactgttcttgctcaccactttattacctggaaccaaacacattaggtttccccatatatatttttaaataagttacttgatgtgtaatgctttaatgaacataattacagatgtttacatataatatgttataataatgatattttgattgcattttatgaaaattttatatgacaaagcactttcattttggttaaagcttcatatataaatatataataaagatttgctttttgtcattgggtgctgttcccttttttgatttcccatactgcttttcacttgtggttcttgattttgttttttactgtttttaacccatgtcctttttctttccttaatctatctttgtaaagtctcaaagaactagtatctagaatatataaatatcactcaaaactgagcactaaaaccacaaataatctagtggaaaaaaatgtgggaaaagccttaatagacatttcactgaagaggatatacagatggtaaagaaatgcataaaaagatgttcagcttcactagccattaaagaaatgcaaattaacactacaatgagttatcactatacacctatcagaatggctaaaattaaaaaaagaaaaacagtgacaacactgaaagctaacagggatgcaaaggaactgggtctttctaatattgctgatgggaatgtaaaatggtacaaccattctagaaaacagtttaggagtttcttctaaaattaaacatgcagtcaccatacagcccagcaattgtactcttgatatttatcccagaaaattgatgtttatgttcacccaaaaaccttgacatgaatgcagtagctagaaacaagaaacagctcaagtatccatcaatgagtgactgttaaacaaactgttatatactcataccactaaatactacacaacaatttaaaggaatgaactactgatactcaatattcacaactccaatggatgtcaagagcaccatattgagcaaaaaaaagtcaaaggttaaatactgtgttatttcttgtatataacattactgaaatataattatagatattaagaacagatattgatattaagaacagatattggttgccagaggtcaggaataaggcagagggtatgctatataatggtgccacaatggagccttgtggtgatggacctgctcaatattttgattgtggtgtttgttacacaaagctacacttgataatgtcgaatagagcttcacacacaaacacacacacacacacaccagagtcacacaagtgcatacttgtctatctggtaaagcccgaataagctctatgaattatagcaataatttcccagtttttatattgtactatagttatacatggtatcaacattgggagaggtaaagtgaagtttgcacaagacattgttgcatatttctttgcgacttcctgtgagtctataatgattgcaaaataaaaatttgaaaaatacagcattagacctttaataagctcttggttttctgaaggctagggtatcatcaccaaacctaatcgaggataagtcttgtaaattaataagtctatcactcaaggtacaaaggatggtttaatgctaatctgctagaatgcaatccatttctattatatgggaacgtgcatcactgattgaataaaatatcatgatgatggaggccgtattctatatgtcctactttgtaaggtgttgtgtttcaggttgtttatgaccaaaaaccctatatgacaagcgctagaagttatgctggtccacgggcatggtaacttgacaatgcctgagactacctgggttttaaacttgcctctacctacaaaggcaagtaatcctggacaagccaatatttatttaactagtattaattgagagcctaccatatttctggcactgagctgagcatgtctactactgtcctcaagaggaaattaggaaaaataatgccccttcacaagcttacttattgttggctttaaaagggggatatataaagtttcttggtgagggtcaaagtgttgagaataatttttctttgtattattttaactattattgttaatcacaaataactaatgtatataactctaaaagataaatgtacatttggataccaacttgtataaacagatacatagatcaaaagactacctctgattttatgtttgtgcgtgtgtgaatgatctccttgctttcaatctggtcttcagaaaatcccaccttgtaattgctgcccccgttgagtttctaaaacaaataagattgtgtgcctccagcttaacgtcctttagagaatcttctagcttcagggtaaaatccaaggtcctaacgtacaaggtctttcacagtatggcatctgctcatgtctctcacctcctgatctgctgttccccaccaggaacacttctgtctagatataaaattactttggttcagcaaataaaataactttggttcatgtaattttgtgtctatgacttgttcccacttcttggaatgttctcccaaaaaccactatcaccatgtctcttccaccaatgactattaatattatttttatctttccttatagaatattgtttaaaagaattccttactaccctaggtcagaaaatggggccccaatatgtattcttattgtaaactcactatggataattctagacaagcaattatatcccctattttagctgtcagtttgcttctcggcttctgactcactctcttgctccttgaggagatagcctgtgcttattatatgtggattaattgtgcctaacagcttgtaggtacacaaatgaatgactacacagcatttatctgactattgtttagccattacatcactgtatacatatttgaaactcaggcatcattcagattggaaaagccttatgaatactggcatgcattattttgtacacacacacacacacacacacacacacacacacaaaatagaacaggatgggataatcctaagtagatacttttttgtccagtgtactcaatatattgtaaaaattataaatcttagactaaaatgttggttgcttaatttggatgattcatataatctgtcgtgtttttggttatctgtgtactttgttttctctttctttcttagtctcaaaggaaatgtccaagttaaaaaagagccccaatttgtggggattcctttgaggagttacaaagctgagatatcttaggagatgccaaattgatgcaaagtggtggagaggtgagcagagtagaaatttggagaatcacttctgctcctatagtgcatgcatgccagggctgctgtcctttgaggtgggcacaggagctctaagtccagtgggtgtctgaggacagattactgagaaagtgaatggttggcttggactacctcaaagacaagtgtttgctcctgcttgagctattgttggaggtttcctgaaggagacttagaacggaatgtccattccagagagtattcagtttcagtttgctgcattcctaagcttattttccaccctgggagctggccacaatgattggaaatctttcatctgttttaatctgggattgagctcatttataaaaggaaacttagtgtctggataaatatgtgtgcacaagcatggagccccatacaagtatgcccaaattcaaggtgagaaatgtttattgcatgactcaaatacatggaattgaatggactctgaaaacaaaaataggatctacagagccagtctaacaacctattcatatttattatttttgcacttaaatgtttgtaatattttattgaccagtgaatatgaactatattttgtatattacgttaacatattattcatgtaataatgaatttttaaaaactggtgtcttgaaccctttcaatttccaaagtattacagaaatccacagatctggtatgcacaggcattttatgagaaaacttagcttgagtgatatcattaatttactgaagtagtaggccctctgacctgcttttataataaaattaagtttctgtaaactaataagaccatagtaactttttctttaatattttatctttgaggagatttgttaaagaggcttgtatgtgacatgacaatctattttgacttataaaatttcaaccaaagaaaagatgcgatatagtatctttgttcttatctatgacaatttttatgatgatagttccataattaaattttttcttaatgaaagtgtatattattgtattatcttcaactaaattagatcatataacccaattttgatctccgtatgccaaaagcagagaattgaccagccagaaaaccatccaggccttatataatatattgtgcctagatgaaagcttataagcattcttctgcctggggctcacattgtagaaatgtggtgtgcaattttgaaagttgaaaatatagactctgattgagaaatggaaaagagtagagttctaattcatgacatctagaaatcaagttctaccactgaaaaattaatttgcatatattcattatcttttatagtgaatgataatgataataaagacaataaagataatatacatataattggttttataaaaactatggcaaaaaatatattaccattctcacttgtcagatgaggtaactgagtctatattatttgaaatataactttaaaaattatattatctccgctactagattatatactcctggatgccgcaaaccacatcttctatgtgtttatattctcatagagttttgaatatttccttgtactaggaagaagttttataaatgtgttttgaattaattaatatccaaaagtgatggaaagaattataagttacttataaatttcttttgtttcaaaccattagatgatgacacttaattttttgggtataatatgatatggaaagactctcagataacttcaaaaactagaattatgcatacatacactcagatttctaaaaataacatgctatcaattcatcctgcctgccaggtatacaattcatttgagttttgcatgcgcgtttcaattgttcacattaaactgtattcatagatacaaattcacttttggaatcttgggtacttaaacaaaaacatagcctttctaatagaagtataaaaaggatactaattgatgaatataccaagtatctttccaattgcaggaaaccattaaaattgtgtctatacactgtatctcttttatcaaagactgtaacaaaatcaattgctatacatattgaaatatttatgtatctggtatgattacattagcttcagagtggttccaaatttaaattcccattggagaaaaatggagtgagaaatttgtacataagagagaagaaatgttttcttttttttgagacagagtctcgctctgttgcccaggctggaatgcagttgtgtgatctcggctcactgcaaccttcacctcctgagttcaagcgattctcctgtctcagcctcctgagtaactgggattacaggcgggtcccaccatgcccgcctaatttttatatttttagtagagacggggttttgccatgttggccaggctggtcttgaacttctgacctcaggtgatctgcccacctcagcctcccaaagtgctgggtttataggtgtgagccaccacacccagccgagagaagaaattttacagttagaatttatttggacacattttagaaatttttttcctgtaaaactcaagtttcatagtgtgtacgtgaatgcatctgtgtgagtgaacacctgtgtatttgtgtgctataaaaagatgaacacaggaatctaatagcataagtcgcaaggtaagagtattgtccaactaaaatagctaacttcagaggtatgaattactttttgttggtgggtatgattttaacattcccttgaatttattattgtaatatttgccactaaaagaaaaaaatcatggcttagaaataaatttaaagtaaccaagatcattgctatataaaccagaatttaaattgagggtttttgaaccattagggtatatttcccctctggcttaaatttgaaaactgatgaaattttagatctcagcacatttaatatgtctaaacaatactcatttgactgcaaaacctgtatatgtaatttccaaggcccagaagttcagtatttgaaattaaattgttgcatattactgagaaatattatcttaaagcatctgctccttctgctgttctaagttaggtgtgtatttctcgttagtgctcagtcgatgagtacaaataggcatgcagcatgagagcagagcattcatttcattgactgcaattactaacatgatttttgacatcttattcattgggagagtgtcttttaatgttaatttgaatgaatgggaatactttcacattcttaatgaatctgctcatagagtaaaataaaacatgactgttatgctttgaagatcaagaatcttcttttacacaaaagggtaaaaaaggccaaagaaggtgaagtgacactcttcatgctagttccaacacgagtattttgatgaacaagaaaaaaagccttctttagatgtaggtgaactgggtgatttggcattccttcctctgaattcccagggtattttgcctgtttttctttaactgcatgcaattcttgtcctttatccactgtttacaggtctgtttctcacaataggcggtgagtttatttacacagtgactgctgttacatatcacatgtactaagtctctagtgattgttgcttaacgatgactgaattgataggtcctagcatggctgatctctcacattattcttgtttggtttgggtttgggtatgaatggtggaaagagaaatggctggctctgagcaacatattacaatgggtttctagcatctactcctcacctagtactagcttagacagtgagcaaaataaaaccataaagcaggccaggcatggtggctcatgcaagtaatcccaacactttgggaggccaaggcgggaagatcacttgaggccaggagttcgagaccagcctggccaacatggtgtaaccccgtctctactaaaaagacaaacattagctggacgtggtggtgcacacgtgtaatcccagctgcttgggaggctgaggcagaagaatccgttgaacccaggaggcagaggttgcagtgagccaagttcgtgccactgcactccagcctaggtgacagagcgagactctatctcaaaaaaaacgaaaaaaaagtaaaagtaaaaaagctaagaaagcaaactatgtgttgtcaagaagtgtttatttttgcatcttgaatttttaaaggaggaggttcagatctatttgttagatgacacagggtttgtgaaaactcttgcagaccaatgaaatcagaacatacaggcacaccaagtgcagattgtgtttagagccactgttctaaaagcaggtgtaagagggttgcagttatatcccagataagagccttagggcattaggaatgaaaaagacaaaatgcaaacaaaagatatttagatatttaattagtaaaacttatttgcgcgggtaatgaggagagagacaaaaatagtagagagcaaatcatcaatactgacttcctgatttcttactagggcagtataggtgtacactatatatatatatataatattatatattatatatatatatataatattatatattatatatatatataatattatatattatatatatatataatattatatatataatattatatattatataatatataatattatatattatatatatatatataatattatatattatatattagtactacttccttttataaattggacagaaagcttatatgtatagaaagaaagatcaggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtggtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagaaagaaagatcaatattttttcaaatgtccagccaattgtttaagtaagttaaggtatgtaatctaaacttataatttaagtttaaagaaaaacattagaccaaatatttagccattttgatgtagccaagtttatgcttcaggagagttgcatagttatgaattgagctcacagaaatacaaatacacacgtcatcatagtgtgatatccagcatagatggggggcagttatcataaatcctgtcctaggctgggtttggaatgtgagacagattttataataataatatttcatctacataaaacagtccatttcctggactataaggatcatgataccatttgtttatcatggctacaaacagaacaggaagtagtatccttcaacagagaagataaattataacagtcattatttagaatatttgcaattcctttgtgtagggctattctttgttagctgaaataaagctctctgccttgattacagttatcattttgtgaaaatattgaatgagtttagattcctaaaggaaattagaagttgagtaaaatgtacattcacttagaaatttccttgcagtgaaagatgctgattactataaatgaagacagggaaatttcattcatttaaagagattactacaggtgacaagtttaaaattagccttaacttaaaagttggaaaatattttttcctgctagagactaatgccaactccgtgatgtatgtaaggtcatgttatcaggacccagcttattgctgctacctcctctcctacccttctcctcatctcttactcctaaccctttagccaaaggctcctatgtgcgggcccccaaactaccatgctttcgtgttgtcagggataagtcttcctgaaattaccctccttctccttaccaatcacttaattaattaaagcctggtttccacttcatctcaggaaaaattatttcctaacccctctcaccaatctccattgactccgccaatggaggttaggtatggttttaaagtgttctcatagcataagttcatcaaaatgcacaatatctttcaccatattttgtcaatttatttactttaatatgagaatacaaatatcttggcatgtttatcagtgttacacggatactgttattttatcatcatgtttcccacctctcccccatacctagagatgagcataaggcttaatatataaagttatttggttaatgctttttttgaataaacaaatacatatctaagggcatgtgagcaacagagttcattgtaacactatgcttacagttaatcatctttttgttattgttctagcagcaagaaggatatatatctatatatatatacaaaggggagaatgagaatgatctgaattcaaatataaaacattacaaatgaataaggaatgtattattttgctagcattgccataacaaaataccacagtagactgggtttcttaaacagaaatttattttctccacagtagtaaaggctaggtataatcagggctgatttcttctgaagcctccctccttagtttgcagaggctgccctctccatctgtcttctcatggtctttcctctgttcctgtctgtgttctaatctcatctttttataaggatactaatcagattggattagagctcaccttagtgacctcatttaaccttaaatacctctttaaagaccctatctccaactacagtcacattctgagacaatgggggttaggacttcaacagacgaatttgggaaaggggcaatttagcccataacaaggagccctgtcaaataaaacagctttgagagcaaacaaaaattggcatctgagtgaaatatgtgggaagaggaaaataacttggggctttgctgttctcttcccactcttcctgtgacccgactggttccctgggaaatggtctttggatccccactgctgcttaagagtctgttttttttcccctgagttactgaggactgctgtcagtatgattgtagtgcaaattgatcctttgtgggaagtacaatagcaactggtaaccacaaagtaccagagggcaaaagaactgtagacgggtaaataaaaggtgtccgaaaagagcaaagggctggaagaatgggaaaatggagaaagtaagatatgcattgagaagactgatgattttttaaaatagtagatgttagatagatgatgagagagacagagagagagagagagagagagatggttaaaggaaaactggtatttggtctgcagttttgctgtttcaccagcttaacaccctacagtgaataacaaggtcatagatcatcacaactgcagaaaacctggagaatattttccatttcctcattatatagatgtggaaagtgagactccagttctcagaaacagttagatacaaaactaagacccagctagttctcagccagtgattttcatatcataccacacgctatacagttgtaggtttagaaaaaatctatggtataagaggaccatgtagtaccttacaatgcttctgtaatacccacagcatcataaagagtaataaatttaattattgcaacttaatgattcaacaattgtatatgtatatacgtaattatacatatatatgtgtatgtataaaatctaccaatacatatgtaatgcacatgtataaaatctaccaattttctatatatgcagaaaacaacaacaacaaacagtattagagaaaaccagggaattaagtcaaaatcatcactcccagacctgaaataaatttcaaaagctcttcgttactggtcctttatttgtccttcctacctcattttttgccccactcatataccacacattgcaactatgctaaactaccttattttttttagaaaaggacatcctcctcatacctacatttgtacatttcctttttatttgcttttttcctctcctgttgccacagtaaattcctaagttttctctttaaggatctgtggcctgctttggatacagttgagtgtagtgatattgtgccttgcacatatctctagaacaaaagttattctgttatagaaattacttatttactatcacttaagatcatttattaccatttactatcatactctaattcacagaaggcaaaaaataaacccttgaatggcaagaaatgtttaggcaatgttgggcaaattgtttatgaatagtgattgcaattaacatagagcttcatacttactggattaaatattgatacttttgagtcatatctctactcttagcaataatattggtgaatattctgtgctgtaagcaatgtaaatcataaaaacattctaatgtgtatatgggtattgaatattcaatgatattaaatcaatgttcaattcatatagatgattcttttggaaattaagaaatggatcccattttaatgagttttccccaacataaactatactttgttaagttcaacttgacaatttacaacgctcacatagctttcagatgtatacttaagatatatggaaatgaaaagcaaaatgttgtgaacaggaggtgacaagatattttaaatttaatcatcatatcttttataattaaccttttaaaacatttaattggcattattgttagaaaactttagctctggaagctaaatctttagaattgttgacttgtagacaagtcaaatatccaaaataaaatttcacccatcattagcagtagatgtatctagggtgaaattacacgctggattacttcaatattcttatatttacatttttatttttttcaaagtttctccagtgagcattttattgtgaaaatattaattatattttaaacttatttttagtttaagatgagaagatagtctttggggtagataaatacttttaaatctttcatttagaagttcctggactaatattatccaggtcccacttccttaaaaaaacctaatgtaacctttcccatataagcattgactgctatttcttgtttcacaacatttatgtggtatgtctatgcctatggtattgaatatatatttgaactctgctggcctattcccatctctcacagatcccaagacaatagagatcatgtcttacccatctttgtatctcttacagaaaatagatctcaaattctacagaagatattgaattgagagtttgagatgttagaataagaaaaggcagtgaaaggagagcctacatgtagcctaggccagatttacaaaagcagtagctcagaatgagatagggattcaacaaggagaaccaaattatttggtagtaagttgttgctaaattgtgggagatgaggaaaagggaataatgatagcagactccctgatattaatcccccaagagtgctctatggcacagtaattattcattatgggccccctctgtttggccccacgcccccaaaaaagacttctttagtcataaaactgaggggaatactacatactaaatccccttagagtttctcaatgtaatgcatatgcaaagatgctctggaatcctgcaggaaagacagctgtttaacttttaacctagtttcccaaactcatttcaccatggaacttctttaacatgcagtcaataaatgcccatttatctaatgtttaatgaagcatatgttggaattcttaaaattgttaatagctaatcaccgtgaggaactggtgagatgatggtaacattaacagaagtagagaaaccaggaataggatcaaaattggaggggaaggggaaaagggccttttgttttgagacatcaacttagaattgttgatgggctatccaggtgggtagataataaaagtttttgtgggggaggactaaaactaaagagttagacttaagagagaaatacttgagaatcacttacatggagatagatgatagttgaagttaaagaagagaacgagatttctaacggagggaatacactatcaaggaaaggattagagaaccctgggggagtgtgaatatttgtgcctcatttaattttcagaaccagatcatgaggaaagaatacttcccattttagagattaaaaaacaaaaccgaagcacagtgcttaagtaactttctcaaggccatataactaataagtggcagatatgagattttgagccctactctaaaacttgctcctcaatttgaatgtttacatatttatgtaaataatatattttacaatattaaaaacgtttttgtagagatacaataaccatataattttacaggattgtcttttttatttacgtttttctttggagtataatacatttttaattattggcctgagaagaagatacaatagattatttttggcaaatggtgcactcattcatgagagacactgtattttctaaagcaggctgatctctgcataatactggctccctgaaaataaatccttgctgggccgggcgcggtggctcacatctgtaatcccagcactttgggaggccgaggtgggagcatcacgaggtcaggagttcgagaccagcctgaccaacatggtgaaaccccatctctagtaaaaatacaaaaattagccgggcgtggtggtgcatgcctgtaatcccagctactcaggaggctgaggcaggagaatcgcttgaacccaggaggtggaggttgcggtgagccaagatcgtgccatggcactccagcctgggcgacagagcgagactctgtctcaaaaaaaaaaaaaaaaaaaaagaaagaaaaaataaatccttgcaatttatctgccatattgaatttgttctggaataatggggataaaatcaaaataggaaataaagtatcaattttattccactattattttatttattattttcatcttagtcatatggaattatatttataggaacatgttaaaatgcattttcaagataattattgcacacaatttaaacaattgttttgagtgactttttgtagaggtagaacagttctgtaaaattaaggtttggctttgctttgtttgacctagattccctattaatttcaaaataaatgtgccttatatttcaaaatcggatttcgtatatgaaagctcatgtcagttcacaacaaaaaaaaatcattaaaaaagaatagtgcgttattttattactgttttgatagcaatacctgaggataccgtaaatgtgtgcatgtacttttgtttacaaataaaaaacagttatgagaagacaaaaaaatctaatgtagaataatttattccactaaaacccagctttcctcatggaaatcatgcaacacctagtgagattatgctagcacatagggaaatttcacaaatgcacattcttagacatattaaccttctggatcagcattcaacaaaggtaaaataatgtacgctattgatatcagactccttagctccctattctggctcccttttaactatcaaaacacagtaatctgtgttttccttctttgtacatcagttattgtacctgccactctttataagcattcacttttctcttgtttttaagcacagtggtagcaatggccatgacttagaggcttaatgaaatgaaggacagattataaacaaattaaacccacactgctttctttatagaagcagctgcagagtgttctgaggtttttttttttccttgttgagtaaaggaactaataaggaaaatttcatggcttcaaggtctagagataagaaatgaaagttgtaacaggagaggagctgggaaaagcacagaaatgtagatttcgcggatcatgatgaaagccacaggtgacttggtgaccacagaaatgagaacacagggttgggtgtctaggcaggaagttgggaggctggtggagtcctggttcaactctaaagtctcagttatctcagcacatgctcttgtggtgctgctgagatttggctgattgcctaccccaaacctaaaaatagccgagcctcattcttttgtagtggcagccagaggcgcagctgtgtggggactggctatctttttccttagctttgacaaatagctgagagttggtgggcttgagtgtgcacctgttgagacagaaagtgctgagtttagttgacaacactgctgaaggtaatttcacactttcattccaattgatcaccgaaacttagaaaaattttctccttttctaaatccttctccttgcccatgaatatatacatacatatatttttctcgaactgtttgagagtgattgttaccaaaggcaattgtttttaaatcagaataacaaatctcctgtttgagtggctaactcaaattttattttcttatttaatttagtagaatttaaaagatttaaaatagttttgaaattaggaaataatatttttattcccataagtctaaaggtacaatctagcccattacatcactataaaaaatcatctccatatttattagattacaggatattccgctttaaactagaatttgcgttgcatacatttttgcagaaaaactcattcttaattttttctaaaacagtagattggatatgtgttaaaggttcatgttctagtacttctttaaatgcttattgtcagctttataaaatcattttatcacaaaaagttagttttctgtaggcttattttccttgataggattccttctcttacaaactggttatatgaattaaaatgtaaatgttagtgaattgtcatatcttgtaaatatactagggtagaactgatatctttatgcaaattagaaaaatattttacagtatcagttatggagttttttttctactcttcctttttctttgttaatattggcatgtgatgaaatcactactttataagtttgctactttgattaagactcagaaatcagagtggctgggtgtggtggctcatgcctataatgccagtactttgggaggccaaggagagagaggatcccttgagcccaggagttcaagaccaccctggacaacagagtgagacctcatctctacaaaaaaaaaatgaaaagaaatgagccaggcatagtgacaacacgcctatagtcccacctactcaggaggctgaggcaggaggatcactggagcctaggaggtcaaggctacagtgagtcatgatctcaccattgcattccaacttgggcaacagagcaagattatgtctcaaaagaaacagatcaatcagagaagtaactttaaatattttaatataaaaaaaggcaacatctcttagcaaataaaaatagcgacgtccttctctttctgtaaatctatccaagacatgagtgctgttatcgattcggtttagggttttgttttgtaatatttttttcccctttcacagcaatacattttggggtatggtttgctgacaatattttccacagtaatcagtggcttagctgtaaatagaggataagtattgcatctggggaatacacattagaaacaattggtatttctggttcatataaaggtggaaaaatacttggccagatgggcacttatttatttattttcctgaccagaaataacaggcaatgtgtgagaaagtgtggaaagcactgggttggccgtcaaaagcaggatcttacaaaggttgaaggaagctaatctgctgagaggttttctttttttaatgactttcacatagtatttttcaaagcctctgtgcattaacactcacgccaaaggaaatgatttgttttttcaagcacttggtcagtgcaatagctccgcagctaataatgacatatggcaaattttgagtacttactttgtgctacgtactgtaataagagctttgtgtatattatgtgagtaaatacttaggacaagcctgtgagagagctattattgttcccattttacagatgaagaattctgagttagaattagactttgaaagtcaaactttctccttccctatcccttgctgttatccaccacatcatgctacctccctgagctcagtgattacctacaatgaggtttaccagcttgtcctatagttacctgtgttataactgccatgttcctgaaataaattaactataaaatggtgcccatcgactgatatagagaccagtcattttttttttatagttttatctggcctggggttatcaagatactaggtttaatagaacttacttccagatttaaatgtctttgttcattcatgaaaatcaattgattggatccaatgattttagatctagacaactgtcagtcatgtaatctaactaactcattgtttaaagaggcaactgaggtgctgaaactttcaataattggattaattttatctttagtcagttatatcattagaacctaggtctctatttcttaatctcaaccaaaatatacatacatacatatatgtgtgtatgtaagcaccatttctgctaatttacaaaaacctagcaaaccagtttaagaaaaaaaaaagtttcctttgctcatgtaacgaaaaagtgaagaggtattacttacttcagatacagttagttttgggatctcaagtgatgtcacctagcccagtacctctctcaccctttctccactgtgttttcaaaggctcttaaaaaaaaaaaaaaaaaaagctcttagacattatctctcgatatgggacccattattagtcttagacttatatcattgtacctcaattccaatagaaaatgaaaacaccattctctccaacagaagacctaggattacttgtaattgactctgaagaaatcacctacacattcctgaatcaatcaacctagttcaggagtacagtgttctgattgggcaggttccatcagacacccactcctggaaccagagccaggtaagttcaacccaaaactgtcagagaggagcaggggtgggtaggccacaacgaacagagatacaacaagacaaacagtgaagaagaagatgaaatgggtagcaggcataataagattataaagtcttgtaggtcccaaactctgtgtgtatgtgtgtgcatgtgtgtgtgcgcgtgtgtgtgagtaaccctcaaaagtatacaagtattgtgcttcctgtaatgacagacacccttctgttgataataatgattcatgtagcccaagaatataagaaagtattctgtttgtaaaataaatatttagaatgggaataaatttgtataaacagaagcatgtttgattttctttaaaaagtgcgtgataaatatgatgatcccaggaggtttgttcgttatttaaatgtttaaacatgtgatatgtctctttcagaataataaatagtagggaatagcaatatagcacttttcggccgggctcagtggctcacgcctgtaatcccagcactttgggaggccaaggtgggcagatcacttcagatcaggagtttgagaccagcctgaccaacatggtgaaaccccatctctactaaaaatacaaaattagccaggcgtggtggtgcacacctgtaatcccagctactcaggaagctgaggcaggagaattgcttgaaccctggagacggaggttgaggtgagatcgtgccattgccctccagcctgggcgacaagagcgaaactccatctcagaggaaaaaaaaaaaaaaagcactttttaaaaatcataatggatttctaagattgtaatagttttggtatgctgattggctttatttttggctacatttattttagaatctctgcattatcaatgaactttcattcaatttcttttctttctttttttttttttgagacggagtctcgctctgtcacccaggctagagtgcagtggcgcgatctcggctcactgcaagctccgcctcccaggttcacgccattctcctgcctcaggctcccgagtagctgggactacaggcgcccgccaccacgcccggctaatttttttgtatttttagtagaaacggggtttcactgcgttagccaggatggtctcgatctcctgacctcgtgatccgcccgcctcggcctcccaaagtgctgagattacagtggtgagccatcgcacccggcccattcaatttctaaattaggcataaaaacaaaattatttcgtaacatttctacaatgacctcctttttctgttaagtttctaattctgaagacccaaattcaattttatatttcagtatctcacactgattattctgatagttacattaaatccctcgtttagaaactgatgcaagttactgttttcaaatgttcatgctttgaaagtacatgtttgtcatctgatttcaaatctgcatggttccatgctgattattttagataacttcaggctgtactccaatttttttctgagagatctctgaagtaagcttttcttactctgttacaattttaatgagatacattctatgtattagagtgtgaaatatctctttaggacaaaatttaatcatagtcagtgctccttatttaaaggctaaaggcatcatcaatttggcaaaaaataaacaacactatctggctgcctgagggtccagtgactgaccttgagttgaaatcccagctgcctgcatcatgtgaccatcaacattctgtttttatcccagtggtaataaataccttatactcaaaaagacaagagcaactcagaagagagatttggtacttttcaaagaaacgcagcagtaaaagttgcatgatgcttttcatttcaaagcaggcaaacagagctttattatggcagagcagtccaatttaattttcacttgtgtgatgaaactattccacacgtttgcattaatttatgagcctttgtctggttttaatgtatttaataatacatttatacactctttgttttaaaaataatgatatgttttgacaatgcactttttcaggaaaatctgaggtgtaacaaaaagtgataatggtaagatagttcccattttgagtattaaaaaatgagtgcatcaggtaggattgggtttggctgcgtgtatcagaaatccagaaatagaagtgtgttaagtaagagagatttgttgccttgccacatgagtgagctccagctggaagcagtacattgccggtagagcagggccatggtggtcaaggacccaggaaccttccatctttctgtgcaactttcggtcttcgatgtaacatcattgtctaaaatggctgctggacctccagcctctttccaggtgtcaggaaggactccagcagagtgaaagggtttgtccaatttaagaagcgccctttacacagctttcctccaaatcccactggatatttctgcttactttcccttgcagtggattatgtcaaaatagtctaattccttcttttataacaattggagttgaaagctttgtttcaatctctagtgacaatactttagattctgattcccattctctgagggcatacatccgtgttactaggttgttactaaatatgcatgaatcttaactcaagttttttaaaattccagtttggaacccttggagaaatcaatacatctgttcgtattttgcccaatagtctctatgagtgctttatctaaaaatcataaattcagatacatttttaatatcatgagactaaagaaaatatttcccgttgtcaacagatatcaagtttcagttataaaaaatgagtaggttctggatatctgttgcacaacagtgtgcctgtagttaacaataccgtattgtatacttaaacatttgttaagagagtagatcttatgttgtcttcttattataataaaataaaataaggtcgggcgcggtggctcacgcctgtaatcccaggactttgggagtctgaggcgggtggatcatttgaggccaggagttcgagaccaacctggccaacatggtgaaaccccgtctctactaaaaatacaaaaaattagtcgggcatggtggtgcgcacctgtaatcccagctactagggaggctgaggcaggacaaccacttgaaccagggaggcggcagttgcagtgagccgagattgcaccactgcactccagcctgagtgacagagtgagaccctgtctcaaaaaaataaataaaacaaaataaaataaaatttccgtttgtatactgtctttaagacccaaatcaattctctctgactctagtgggcactgatatgttctactgaagtccccatcaccaggtagcacacccatcccctagctgctgggagtgcttgttgcccacagctgcttccttctccagagacttgttcttaccctgaagaaagccaggagcctgaaaggccatatgtgccccacctcaggtcagtttgcaaccaacgactgaaagtacaagagtccaacccatttgccacaaggtgagatcagctctgggatgcaatttgccctccagagctccctgtgggatcatgtggaaattggtctctaggtgagatcgcattcttgttttgttttccccaagccctaaactgtccccttcacacagtttctcttttgagcactttctctttttattttattttttgagacacagttttgctcttgtagcccaggccgcagtgcaatggcatgatctcggctcactgcaacctccgcctgctggattcaagcaattgtcctgcctcagcctcccgagtagctgggattacaagtggagcgccaccatgaccggctaatttttgtatttttagtagagatggggtttcaccatgttggcaaggctggtcttgaactcctgacgtcaaatgatccacccgccttggcttcccaaagtgctgggattacaggcgtgagccactgcgcctggcctattctaattttcatcccttcactcacaaatgctatgttccatcaacagcttgagtgtgcacatgagcgcacacacacacacacacacacacacttctgtgcttgctttttcgtggctgcaaacctgctctcttgtgaatccctgaatccacgtatgaagccgaagcttttatttcattttattttttagttgacaatataattatacgtatacctggttttttttttttttacattaactcttctccttatttcagctgagtttctatttatgcacaatatttattgttccgactcaggggaagtttcaagacacaaaccttttgacagcctaaattagttcaggtctaattcagaaacagaagtttccagattagaaaacctgaagctaaagaagtgcttgaagaggaacagggattcatgcaaaactagactaggtaacagagttactcatacacaagaatcttggcaagggttgaagtgggcatgtggaaggggctggcttgaaaatcaggagggtcagagaaagagctgttattgttaccctttgttcctcctcagatgtctatgcgaaaggctctctgagatgagagcacgatatagctcatgccggttcagccacttaatcttttttgatttgactgcacccaggtttctttaaatctgagctttagtttccttaactgtaaaataatggaaaaattcctggcccctcctcacctggttgctatgaagattaaatgagataatatatggaaaagtcttagcatataataaggtctggaacatgatatacatttaataaaataatacattttacttattattatcttatacctttcatatgaatgttaactgcaaaacagcatagccggtatttgctccttcacaatagaaggtaatatgcttccctgttttactaatcagaaaactggcctcgaagaggttaaattcctttcttagaactattaagaggctaagccacacttcaaactcaggtgtgtctgactctgtagtcaatgttcttttcacttcatggtgcttttttcctgtaaagtgagtataatatttcctaaatcataataaagctttgtgcattggatgacataaatataaagggcatagtgtataattggtactcaataaattattccttttcctccttccctaggcaagaactaattttctttctttgtttagcccctgtattaccagccaagtgccttgggcataatatacgtaaataggcctagtatgttgaattttaggcagccatcttgatttttgtaacaaatctagttctctttaaactattgcttagctcttccaacaataacaggccttgtagttatcccacatggggtgatttcaaagccacagagggaagattgttcttaagttactcctgcatgcagtgtcaagctctcacaactttcacaagaagttaaaaactacaattttatgtcagtctctcctccagtaatcagatagcttctttgattgttctgataacccaagagggaatccttctgatacagaaggtggctatatctcatatattttgcaactcctcccaaaacatagatcgatcatctcaaagaactacatgggaaacttgatagccttttggaggctgagaaagaaagctaagccaaccttgaaggaagtcaacaaattgtcaatggcattttgaaaaactgcattgcaatagacatctacactcatacgttatttagctcccttagggatatgattactcttggggtccacaagattcgatgcatgatcatttgagaatatttgtggctactattattttttaaacagatcaacaggcatgacagaatttcatgcatgaatttcatgataaggcattctcaattttatgttttcacttaagtgattatctctaatgttcatctatttccttcttatttcaatcctaccctagtttcaacccatccttttttatttttttcttgtttgaagtttaccctaatttcatgactgagcttctctaaattccttaattaagtcctccttgtccatcccagtacaaggtgtaatcactttcccctatatctggattgttcatctggttgttatgtattgcattaagttaatatatgcaaatataagccttgtaaatacagagaccaatgcagtccaattttgggtagatgccacattcaaaacaacaataacaaaaattaattaagtagtcacacacttaaataactcaaaagtgttaaaacagatatgaagaaatccacagcaacatttattataaaattactctttctcttccttggttttgcggcttctcgagttcataggagactttcagtttccagtgacctggaaactcaccattcctcatcaccatcctttactgtagtaacttccttttacctgaccaccctgcatagtcacagaagatgcactcctgacaagtgatcctcaaaacaggtagtaatctctttgagaagtgtgaaatgtcttttgttctccttgtcgttcccatgattgtcagctgtgaggacccttgtcattctaccctcaatcccaattctgcagggtctggggattctggggattcttttttttttttttttttttgtagttaccaatcttatatagatacaataatttttatgtgtattgatgtttattgacaaccagattttaaggtccttagaaattggagttaattattatttatcatccaagctcctttccctctgccctcttattttccaacacagtgtcttgaattttatcactttatcgtttagttattaagggtgatttggtgaaatgtagaacagactatatgaattacctcagcttatggtattatatgacataataacagaaacataaatagactatcataaatcttaactttttctttattctttgtaatattttattagtcttatccatcttgcttggattgccaagttcttctgagaattccagtaataatgttatcattctatcgagcttattattcccaactgatcttctattaagccagtatgaattagctactgtttatgagattagattatgcactttaatctctagaagaagcaaaagtaatgaatacactgaatctgccactgagaagacactttaaactgaaatgtttcattatttttctaattcctctctcttttgaatctgagtatgtttttggggtacgatacagtgtaaaggtttttgtacatcaagtcatagacttggaaataaaacacaaacaactacccttttgatgaaaatacataaacatcatagccatttagccaacttttaaatttaaaacaataaattcatgattttagttggagggtaaacatgcatctttttaaaaatcaaatgtaaacacagaatctatactcatgatgtacacacatggacataaaatattgcatatattttgggagattcaaagaccactggactccaagttaaggatatttttctctaaataaacttagtgattgaattatagaaaaccacaaactaagttattgactgaagtataggaaaagtatagtgtattaaaataaagttttggactaattaacatgattttactaatagtgacaagaggatttaccaagttctgattttttctaatgtaaaaaaaatttgttaagtaagatctttcaattagtaatttctgaaaccccctctaagtaaattaaatttttatatccttgaagaaggatgttgatcagtctcaccttatggcaagtatctcaatatatgtgatctgtcacctagtcttttctctattttattatttctgtgtttgttgagaaaaaaattatttgtatacaagtgcatgtactatttaatgtcatgtaattaaatccctttgatagaaacagttaatgttagactaataatgtttttagctactggtgaaatacttcctcctaatgcgttaaatgcaggataagatcttacttgatactaccacgggagtgtaatctctcccaatagtgtttgtttcatcgaagttggctcatttaggtagtttgagtggccagagttgtataagtatgtttggcagtggtggatggggaatggacagcaccaaaccattctttctctctgtttcgatttttctcctttgtctattgctagttgcttattcctgagatatccttcacctctctcaagaggcttggtcacttaacttcattccaactctacacctccattggtggaaatggaaagatggatgaaattttagcccctgtttatggccagcatccgactagtccttctttcaaaaatgagtaaataaaaacttattatggtatctttgaaaagttgcctgtctatgctctaggctttaactcaataaattattttaatggaaactgtgaattcaaaggaaataaaagtatggcggggaattatgcagaaaatactgtaatatatgttgataaaattttcccaagttaccacacctccagtacctagaacatagccagccatataatagacactcaataaaggtttgttgaatacatttgtttaatattcctttttactcttttcctcccctcttctttcccatgcatttctagttactcacatttataataatatattcagtacattttttgtttgcgtcaagatgcatcatgagggaatcacctgaaatttcaagtcaggatgacctggttagaacatcagttccaaaactgaatatttagagatccttttcctatctataaaattggatcacaaaatatctctcaaagggtacaaagcacagcaccaaccatatattaataataaggcactgttacataaatgtcagttcattttctcatcaccttcttaaccattttgctctctcttctgtttcaagacagtaaaatccaaatctctgtcagtaaaagtatatctgaccactctaatttaataaaatgcagcaataaattgcatgactcatttctcaattattttgcatgacttactaaaagtataagacagggtacctgagggatctgtgagggaaaggaagcaaaaatcatatacatagaagtggttggtttcaagtgattaagaataacctacgagtaggtgaaaaaaagaatcaggacaatacaatagactgcaaccaaaggtggaaaaaactgtaaaagaaatagctttagaggtctcaaatctgctttcagaatgctaggatctagttttcgtaaattagagttctcagtaaatgtaggacaagtcccagctgtactactgtagcattaacattaaaactaagccatatcttgaatctccttttctcttaaacccccagaggtttcaaaccagagaggtggtcaaaatagattcccctactacttcccctttctcaataagaagctctcatctgttgaatttccattttgaggcatttagacagctgagagagagagagagagtttaaaggagtgttcaatccatctggtctgttttttccccaaattgcggaagttatcatttcagtaacattatatgttgttaagcttatacaataagatctgattttaaaacttaccacataaccacagcaacaaatattgtgttatattgtcagaaggattgacacatagatcaattgaacagaataaagagtctagaaacatacccacacaaatatgcccaacatatttttgacaaagtttcaaaataaattcagtggaggaagagtagtgttttcaacaaatggtgctggatcaatgggacatccacggacaaacaaaatgtacatagacctagacctcatacctactacagaaattcacagattagagtgagattatttttctctttcttacagaaatcacatccatattgtctacttctgtgaagttcagtatggtagccacttgccatctatggccattggaatgtagctagcatgaattgagaggtactataaatgtaaaatacacactggactttgaagacttagtgtaaaaataatatgaaagatctcaataataattttatatgcgttgcatcttgaaatgatagtatttgggatctgtttggttaagtaaaatacagtatggatgttagttttacccatttctcattatttgtaatgtgggtatcagacaaattaaaattacctatgtggcttggatcatagttctattgctcatagctagcataatctataatttccagtttcagtttctttatatctgaatgagaaataaaagatatttgtgaagcaatctgcacatagaactaaagatttttattatttttaataaaattttacatttgtctgtccaagcatttgaatcattttgcaaccatatttattgattatttctacaacattcagtttagattttgcataaataaaaacttttgtaagtgtatgacttaataaatattaagcaggatctagtctagttacttgggaacggcaaagccctcgtcttcatggagcttacatttttcagttgataatctttatgtaactctagaaataattataactggcttaactaagttagcttttgggtacatactcaacttgtgagagcggaacctcatgggtctaccaatgagttgagtattacctaaaagtatccatcttgccctgggcattagccaatgtacttttcagaggaaatgcagggtgtttgttaatctggcaaattacctgagtaggcattggttacatggaagtctattcagagattttcctctgtactacgttgtattgactgattgcttttctgactttctccctagattctgaattcatcaagagttctaggaggggggctagcgattaaaaaaaaggacacattaggtacaatataccctactcaggtgacaggtgcactaaaatctcagaattcaccactatagaactcatttgtgtaacaaaaaaccacttccacccctaaagctattaaaattaaaaaggaaatacaaataaaaataattttaaaagtttttgctgcgtgttagcacctatgtcagtaattggtaaataataagtgtaaataaaccaactgatggatgaaatattttgagagaacattaattcaaaatttaaaccagtcaatgtcacattcaagccagattgcccaacctagtatatcatgaccattgacttcaatctttaatatggattgtctaagtcattggctggaagggagcatctgtctttgttttgtcctttgaagcaaacacttgaaatcagtttagactctcatctagacatttttgttgtttagaaatatatttaatggaatctttaggctagattcagaagagaagtaagctgtcattacccaaggattgttaaccttatcaataaattcgtagccctagggcataaagatcatttgtattgtttcagaggccttcgtgtctagtaaattttctagctattgatttttgcaaatgtacaaaattaacaattgtgagagagcttttaacaagcttgatttcagttgaaataatatgaacagtaattgttttttttctgttcattgggtaataaaagcatgtatgtaattgggaggccccaatactgttgaaggtaaatctgatgagaaacaaatattcaaagactttgtgcatgcaagagaatcaatagaggcaaaaaaaaaaacctatcttctagagagttgacaggaatctatcttatttggaaattcaaaaggtattcatgcatttctgtgttctgtgccagttacattatttatataataaatgcttttccatattgctttttatttgaaattctcaatcctataactaattattttacttagggaatataactgtatcctttacgccttctctttgattttgtcaccatgatcatcaaaagtttctccccatcaataatccaggtagactcccagccacactcaaggcatcatcaatgatctcagagtactacattggattaattactaatttttcctcattgacttctgttttccacaattcaatatttttctaattttcatttatctgcttgcttcttcctaaagaaggctcatgtaagtttgtatatgtgacaccaatatctctttaatatgtttaatttccttgacgtttctaaatagggttaatttaaatttaccttaagacccaaattatctgaatgcaagtttccaaaaaaaaaagctatatatcaggaattttctaggattcaatttcaaaaacaactttcagagtatggctaataattcaaaggtcaacaaaacacctgagcccactacaatcccagtaccatacaggtcaaaatcaagatttggcaggattgtaggatcccaacgttctttctgatgttaaaaaatatatagtaaataaagttattttttgttcaacagtattttggaagtagtaattgccacattgtatatatgtttgccattagccataaacgtgattttaccaatttattttcactacattgtgcagaattccggaaacttagataaaatattttaacacctaaatatatacacacacaaacacacacacacatgcacacacgctactcttccatgcccccaatctttctctttatctcagagttcaagtgtagccatgatttgacattacaaaatagaaagagtactgttggtttacctgtcaaattacttttatcaagccattaatggtgcttactgtgtgccagacattttttctaagcactttataaatattaactcatttaatctttataaagcctttaaatgatatatgataatattctctctttacacaaaaggaatttaagacactgaatggttaatgagcatgctgaaggccacaccattcataagtggtaaatgggaagtgactctgggccattttgttcccaagtccaagcttttaaatattttcctctgctcttactagacatgatattgctgagaaaagttttggtcccctgtgcttgaatataagtataataattaagtcatcttcttttccatgctcaaattttactctcaaaatcatttttctgtgccacacacattttaacagtttttcattatatacttgttcttctgagtagaaattgactctaaaatacagacaaaaagaaattatatttaagataaagtaaaaaaaaattctgggtgaaggatacattagaatatgtgattcaatttttacaactttcatataagtctaatttctttcaaattataaagttaaaaatctttcaaataattactagtcgaattgaagaatatgaattgaagcagtaccatttagtgcataaattcaaggacacaattttcaagttatattttctatgaacagtcctccctgaagttgtgcaaggagaaagacctaaatcgaagttagtttacctacattaaaatgcataaaataataatagaaaaataaactgaagcaaggacaataatatggattactctccagctttcataactgtgtttttaaatgttcttcagcagaaattattcaagcgttgtttcctactacagaaagaattctcaggacttctcagaaatacgtcagtttttaataataccaatacctgataggagagcagggacaatttcagtgtcattcatagatgttgtcccagaaccaagacagcatctgctccatagtaggtacttaatttgtggaatggataagcaaatcagtgatacatatcgatggtgctttttctactttaaaccacttttaaatgtgttaatatcccattaatagccttctagatttatttgagtagaaattaattcttttatttgatagactagtaaaaggcagcctagacagtttaaattgctcattcaggttcactcaatgaatacacactgaggaaaaaaaatatatatatatatatgtatgtatgtatattcagaaataaagcccagccatgactttttgttcaaggttctttgtactatattccattctttgaactgaaaagaggagaaattatagaagaagcaatgttttaaaaaatagacataaatgcataaatcaggtaacacacttttttggatacataccccacaatacctgaaaaagtagtaagcaaagtcactgatatttaatagaggaatgatctgaaaactttacaaatcaaaataactttgcgctttcaatttttagaaattaagtatttctccttactgaattcatccgtatgtagaaaattatgctgtattatttcaccataagttttaatttaggagtatgggttattatttggaaagggaaatgtttctcaaatttacttccatgttttaaagaataatcctgttaatctctttctcacatcttctcatatatcttatttcacttttaatttcctgtaagcttatcattcctgttaaattactccttgccttttctcagcgatgattgataatgatattgttgagctgtgtctctttctaacacctagactactattcaaactatatcaatcactccattatatttttaaaacctagaatatactactgagatctctcttgacctggtattcctgtatcctgccatctccgatttcccacactgagcacctttccttccttcagcatcctttccaatcagttcagaaagctgcccttaatctgctattctgttgccaaaacaacatcattaatcactttcagttaccttctttgcttcctatacatcaaaacttgagcgcttcctttaccctcagttactgctccactagagctttcttgttttaacgccccatcttcttgtcctgtgtgttttggttttcttcctcttcttacttgatgcccttgttttctttttgtgctattattaccttcattttattttctgtgcatgagcattgcaaattacaaaatcatctctttccccctttgtttactacttatttggttccggtacttcttttattctgtttgtataaatatgtactgaaagcaactgcggaaaaaacacctagatgaattgtgatcctatgtcgtcccttagctgagaaacatttcattcctgagctgtattatttgtcttttctctgaatacatttttttttcatactggctattctcctgtatattctaaacacacctttgtgtaatttaggtgaaattgttggaattataaattgtttagttagtagttgtgaatcatgcttactacagacatgtattatcaaaaatttcacaagaaggatagcgtgatactcaggcactccccacatttcctcaagccaccaaagagttttttgatggatgttcttgtttattggatgctctaaaactagacagacagtaaagattatcttttcctgctgctgaagtttaagtcatttttcccctaacttttattcacacttccaattatgaacttctaacacataaagaaaattgagatttttgtcatgcaatgctgaaacccaaactgacatgtaggaggaaggagcagcagttctgtgggtttgtcaggatgctaaggacatgttgtttttcaaattcgttattagagtcagtgagtttattaggctgaggtagaaaactgtatgctattagtcaaatttaaactaaattcctaaactcaagtcccttatagctcaaaatctgtagattcaagtaaacacttctagaaatgtcctaatatcacattgaaggagatgttcaatatgattttaatttagctgtctaagtctgtatgcaaaaaaaaaaaaaaagaaagaaagtaagtaaagcaaagcaaataataacctcaagtgccaactctaattaattggtagtatcttcttgaactaaaatgtggagaagtcccatctggcctctgtaggagagtgcaatgatctattagccatgctaatagatcagcccaggagaaggaagagaacaggattgttgattgcctgtggaccctgttgtgctagaacatttttcgtatgaaagtctgcatttcaggtgtggtaaattgtttatcagaccacttattttctgatgtgttctactttatttctgatacttgattaaaggtatgctgtgaaagtagtgtagtaataatgactcctaaaatgagtttatgcctctgaaatatagacacacgattcttcttcaataactctgcttatctgcttttagaaagtaagcccggaagtttacggactattgcaatattagattttaccatgtgtgtttattattgataatctaaaggtgaatttattaagctctacattggctaaggagccaaggctaaggattacaattaaacagctcaattatatttagcaagcaaataaaaccttaaattataaagcttccaatgatagcttaaagctcagaaatggccagttttttaaactaagcaataaatatatttttaaaatatttatttctagtgttacacagatgaatttggcacaagcttttcacttccttttgtgaaaaacttgttttgtgcatattccgtccactattttgtgtgtaatactctgtcatatcaaattcgattaattaaacaacctttatgggcatgaaccagccttggtctataacaatttgcaacttcaaagagacaaagtgattttcaaattactgcctaaaaatctatttaatatatataaataagcagaaaaaatatctatagtctttactggagaaccatgcagtagggtggggggagcatatggattttattttggcaagtgaagaaaaaagttattaagacatacaatacaataaaaaagaattcacaacatttagcaacagattggctgtgggtagcagaggctcatgaggagtcgacaacaactttctaagatattggcttagaaaacatgagtgggttgacttacatgttgttttctggagttgagaatgtttttactttgaagaacttttaacctcctctacaagactttttagctacgaggtccccttatcactatgagtaagagaggaatgcaattctgagcagatttctcctaaaactttatatagatagatagatagatagatagatagatagatagatagagatagatatagatatatatagatatagatatatacacatatacatatatatatatatatatatatacacacatatatatttttgagatggagtctcactctgttgcccaggctggagtgccgtggcacgatcttggctcactgcaacctccgcctcctgggttctagcgattctcctgcttcagcctcccaggtacctgggactacagtcgtgtgccaccatgcctggctaattttgtatttttagtagtgaaggagtttcaccatgttggccaggctggtctcgaactcctgatctcgggtgatccacctgcctcggcctcgcaaagtgctgggattacagacttgagccatcgtgcccggcctgtatttttaaaagttgtctttactgaagaggtctgttctaaacacgtattctgtgaggatttgattccatcattttcacacctgttactggcctgacatatcacaatgttttatgagaaaatagaaatgttatgaattcatttttaaattgtatatattgtacaaatttgtattaagcgaagccatggcaggatagcagtctattatttgccttctgtgcactgcagagttccagcagaggtggactttcctccagtttattagagaattttaaaatgtcaaacttcagtcaatagtttatgctgtttctagacctaatataacaaataataacctaatattgcaggtcattttcagaagcagtaaaatgctattatcctactaaaaatttttggagcacaatcacatgatatgaatttcttacacaagcatataagcaataaaaattttacagaatcttaagtgaggaaaaatttgaaaatgctaaaaaaaaaaacagcataaaaacagagatcagaaagtggctttgataattcaacatagaacagcctttagcttttgggctatggctctcaaaatatccaaaaccagttatttttggtgtgtgcgtgtgttttctgattctatttgctcccactcttccaacagcagtcccctgactcttccaatccctcagactcaaaatctttgagtcagtttcaagtattcgtccctttttgtcaattcccattaaatctgcttttgacacatctattcacttttatctttttctaagtgctatcatcctagtgtagggcttcatctccattttcttactaattattttttcaactttcaaagaatcctagaagtgtacacttattaaaatgcatttcatgctttggccctactttaaagcctatactgcattgatttgaatatacacttcggcagtcaacgtccctaaccatctgatcataagctaattattaaattggtatttgatattttaatggcacttgaaaatttcaaagtttccacagttattttattggattttctacaaaaccatctgtgccaggtagtttttattacctatctcttatccaagaggaatataagattctttgaaatttgacaacttacagactacaaatctagcaggtgttagctgtggaacttgaactcatatcctcagattctaaaacagtgtcttagtcacactacccccagtggcttccctctctatccaactctcactgtccagatcatgttccataaccagagttacagaacaattataattaccttccccatccaaaggcttactgtgccacagctcatttctagctgaaattatttcattttgagagatgaacttggacaattaattttggaaatatgaatgcaaaataacttagtaatttaacaacttcagattagtgtagggatagtttcaggagtaaattaaatgttgttgactaaggaagagaaagagaaataatgtgataaaaattattgaaaaggggtatacggtaagccttgtgagataaattctctctactcttgggcttattcgtggtagacatagagctcagaataggttttgtgagatgggaaggaggaattgtatgagctgttattgagagattaaaggttattctgggaagaatacatgtttcagaaacagcaaaaggtgggctcgattcctggttgtcactcattagtcacgtaaatttggttgtgttgtttaacctttctcaacctcagatttatcaataataaaatgggaataacaatatcaccctttctggttcctaaaatactgaacataatatatataaagagttttgtaagaaataggcactcatacataaaaaatggttttattctctaccagcatttgaccttgggcacattatttaacctctctgttcctcaatctacctcttctgtaaacatggggaaaataacagcacctacaccttgttggactgttgatgattcaaagagcagccgccatttgtgatacccttagaacagtgctcaataaatgatataaatgatgtgactaattgataaagacaaaagtcttgtgtttcccttagaaagatgatctaactatactgagactcaatttcctcatctgtaggattgggacagtaatttttcctttaatgttttgctttagtatttaatgagatacgtgacgtatttcatatgcaacaaaatgctattacaatgcaaagagttctggaatatcgaatatgttacaaaatttggggagaaattattagagtaatagagaatttttaacacctaggttggacatttaattcattgatagagttctaatttaaataagattaaaggtttaaaaatccttagttttgtctttaaattttgttatactatcttaaagtttgctaaaaaattgctgtgtctataagtttactagatcatcaccggcaggcaagaccaagattatcatctggatgagttctgtttgttagagatagtaaacacgtgatatctactcaacaccctttgagagaaactcacatttcctcttgataaatgaggtcagatattggtatcatatttaatgtcttcttcaaaagatcgcaatctaagatcactgaaggactttagaatccttgctggcttttgaataatagatttctaaacttaactttgccctgccaaatttatgtatttgttttaatggaatgtatttaagggttccatgtaccattgtgctatttttgcatgcccaggcatgctcggctgagaaggcaggtgaggactgaaatccagccctttgtaaaggcatccaagacacactcatgggattgtgtctgccctgaggaagtagagccttccttcacataaaggcagtgtccctgactaggctgtggccctggtagctgagtccaccctagaggacactttgcctctatttttcctaaacgcgttgctgatatccctcgacttacagtggggttatgttccaataaacccaccataatttgaaaatattataagtggaaaatgcatttaatatacctaatctaccaaacatcatagcttagactagcctaccttaatcatgctcagaacactgagattagcctatatttgggcaaaattatctaactcaaattctattttataataaagtgttgagtatcttttattcagtactgtacttaaagtgaaaaccagaatggttgtatggatacttgaagtgtggtttctactgaatgtgcactatttcataccattgcaaagtcaaaaaattgtaagtggaaccattgtaaatcggggattgtcattatatactttagaggtaggcctgaatgtgatatagataaaaaattgattgtatttttaaattgtatttaaaaattgaggtatgcaattcctcaaggatctagaaccagaaataccatttgacccagcaatcccattactgggtgtatactcaaaggattataaatcattctactataaagacacatgtacacgtatgtttattgcagcactattcccaagagcaaagacttagaaccaacccaaatgcccatcagtgatagactggataaagaaaatgtggcacatatacaccatggaatactacacagacattaaaaaagatgtgttcgtgtcctttgcaggaaaatggatgaagctggaaaccatcattctcatcagactaacacaggaacaggaaaacaaacaccgcatgttctcactcataagtgggagttgaacaatgagaacacatggacacagggaggagaacatcacacactggggcctgttggtgggtgaggggctatgggagggatagcattaggagaaatacctaatgtagatgatgagttgatgggtgcagcaagccaccatggcatgtgtatacctatgtaacaaacctgcatgttctgcacatgtatcccagaatttaaagtataataaaaaaaaaattgaggtctgcaacaggcaaagccactaaagaaactcagatatttttcattgtaatgttgaaaaagttatgaaatttcactaagcccgtgtctatgaagtgggaaaataacagtgatatgaatattatatgagaacatatttgtaaaatatttgttgtatgatagatacctagttttgaatgttagctatcatttttggctcttataataggttattggaaggtaggtgtgactcctatcttttaagcatgcagaatactgaagtgataaatttcatcattaattttcagacctttgacacttacttcggtgtttaaaaatattgatgtatgcagacagtttatctcctaaatatgagggaatgttatcatgatcactcaaaggatataccataactcatctgacatttaaaatgtcagtttgattgataaatgagagtcctgggtagatgaatgtgatttaaatggggtttggtttgcatacagaccaaataaataatgattcagttctgaagactggctagactagggctagggcaattaattggggtgctgggacatgatatctgagcaacagatgctaggttatgctgctttggtcaccaacaggcctgctccataacaggcaataggtacatagacctgacatttaagagcagttaatgtaggcctcaagaccttgaatggtaattaactaacatgaagaaatggaacagagtgtcaggattatctattatggcacaatttcctattctgagcatgcccagtggtgggtcagaggggaggtcaaggaacagatgggatcaggaagtaaagagagctctttccagctaggacaggcctgaggggaccgaatagacaatgcaaggcagagaatgagtcacaaggaacaaagaacctggcgaaaaccagagccacactaggtttctgatgaagctggccaccatgggcttctctcatttaagacactctctcaatccctcacgttcttcaggttggcatatgactgaacttaaaggctggagagctgcagcctacatgaggctagcaaataattaatgcattacagagcacttaaaatatgatacagaaatatacaattctgcatgtaaatccaagtattatgaaggaccaacacagaaatatataggcaataatattatgtgaggccataagataatgactttttattataataattatgcctgatctaaatgagctatgtttgatttctgtgtactttcatagctttatagccaagcatgacttctctgcccagaaaatcctgcctgatttactctttagcttctctctaatttactttctttttttgagatggagtttcactcttgtctcccaggctggagtgcaatggtgcgatctcagctcactgcaacctccacctcctgggtttaagcgattctcccgcctcagcctccagggtagctgggattacaggagtgtgccaccatgcctggctaatttttgtatttttagtagagatggggttttgccatgttaccctggctgtggtctccaaccctgacctcaggtgatccacccacctcagcctcccaaagtgctgggattacaggcgtgagccaccgctcctggccctactttacttttaccagctagggactgtttctcattcaatacatatatttgtttgtctgctaagttggatgtagtagttgagtagtggagttgaaaactgagagattgacagcagtcagttcattgaggattgtgttatcacgtgcactgggttagatagtgcaccctcaaaattcatgtcttttctggaacttcaaaaatgtggtttttgtttgcaaatggggtctttgcagatgtaattagttaagatgatgtcatattggagtggggtgggcctttaatctaacatggctgatgtccttataagaagaagagaagaaatacagagaagacacacagggagaatcccatatgacagaggctatcccgagtgacgtgtctataagccaaagaatggcaaggattgctggcaataccagaagctaagaaagaggcacggaacagactctctcctagagtattcagtgagagcatggccctgctaatactttgattttgaacttctagccaccagaactgggagacaatatgtttctcctaaaaaacaaacaaacaactacaaaccctacccagtttgtagtactttttaacagcagccgcaggaaactaatacatcatggaaatgaatttaaacatcttattatctataaagaatgtgaactgtcaaagcttactgttccattggacatcagtttcgtgtatcttttatcgtataatgcatgactagagtaataatttcaaaggacattaaaaaatacagacattttcttgaaggtacccaaacgtttgaattgtgggtcaggccaatatcagcaagggcatttgatagagtttctcacaataaccttctgtgcatgtaaataactgtatcttctcaatagatttgttattgtatatttggtcttgtagacttacccgaggaagtcagataatagcgtatttcgatatactgtgagaaaaataggtacacactaaataggagtatgaaaatacacaaagaattacccatcagcaagagcacattatatttgtttttcttgaaacacccattctttcctccttctactttgttttatttttaatctggctctcttgcttatcttcaaagttttatctcccccaataaatcttcctgccatggtgaaggttaaatgtaactcttccatcatccacgctagcacataccatatgcatagaagttataaagtccttgaagacagagactctattttacacatctttgaattcaaagccctaaaatatttgagccctgaagaagttgttaggacattttagccaccagtgcatactctagtagtgacggtagtgatgtaagtacattcctcagcttttctgaacattagtgaagaattccttttaataaagagcaagattttccattgatactcagatggacaagttttggagtattctcagagatgaaaaaggattatttttcatttgatgtacatgtattctgtgattttgtgaacacaatggatgcttgctcttttcattattattgttattcctttgggtaaggcctttatgttgtcaaaaacttctatttaaaaaaagtgaaaataataaaacattcagccatttgcagtcaattattcttgccactggttagtatatttatttaccagggttcttaattaatgttactgagaggctcaaagatctgaaaaacagcattggttccaagtggctgcatttctttcttattcatttatttattttttagaaatgaggtcttgctctgtcacttgggctgaagcgtggtggcgcgatctgctcactgaagcctcaaactcctgggctaaagtgatcctcctgtttcagcccatgcctggttaatttttttttttttctttgtagagatggcatctccctgtgttgcccaggctggtctcaaactctgggcctcaagtgatcttcccaccttggccttccaaaatgctaggagtacagatacgagccaccatgcccggctagctggctgcatttctttaaggcccagagcctcctgtggtagcatctggatttgaaatgctggctgggtgcagtggttcaaacctgcaatcccagcactttgggaggccaaagcaggtggatcacctgaggtcaggggttcaagaccagcctggccaacatggtgaaaccccatctctattaaaaatacaaaaattagctgggtgtggtggcgggcacctgtagttccagctactcaggaggccaaggcaggagaatcgcttgaatctgggaggcggaggttgcagtgagctgagattgagccactgcactccagcctgggtgacagagcaagactctgtctaaaaaaaaaaaaaaagagaaaggctcataaacattgtctatgtctaagctgcaacaatgattgatattgtgaagattattaatagtgtgggtcaactgaaggggaaggaaaacaccaaaggagaatttttccctcccaaatcataaaggcattcatttttcagagaagaagagaggaatattactttcattaaaagaataggaaaattaaaattgttgttattagccacaaatcagggtagagctgtgtgaatccatggggagaatgtaagattataagcagaaatcaaggttagttttgtcttgtacttctggaataagaaagatgatatgtaatcagaccatgtctctgataattttgttaaattagatgaagaaaatcacatggataagaaaatgtaattaaatcactaaaaataagaatgtcattgttttcactttcttttgctaagtaggaggtgaggaaaataaccttttactctgtacatgagtaattccaatatcctcttagaaatgacaattggattgtaaaatgggcttgcctttgaccatattctgaaaggataatataatgagttggcaaaagaccccatgaatagagtttatgtagaaagcaacaaaaaaacacaaatataaagaaatgcctacaaccaaaggtcagtataattgatagcaagatttcaaggggaaaaattagggtcagggaagatataaaatttctgtctccttgttttggtgatttttaatctagaaataaaacaggaatagtgaaatattccatagtatatctaaatatccatctttgtggcagggagctagaaagattcaggattattatttataaaccaatttagactaaattcaaagactgaggagatacacctaatttagaagaaacaggagctctgagacctgactttgcatattactactaatttttttcttagtgctcgttttgctgcccaggctggagtgcaatggtgcagtctctgctcactgcaacttccgcctcctgggctcaagcaattctcctgcctcagcctcctaagtagctgggattacaggcgcccaccaccacgcctggctaatttttgtatttttagtagagacagggtttcactgtgttgatcaggctggtctccatctcctgacctcaaatgatctgcctgcctcggcctcccaaagtgctgggattacaggcatgagccaccgtgcctggccagggcctttttaagtattattttttcttctaaagttactgatgctcaaatgaaacctaattttgaaaaatagaatgtttgaaagaaatagattgaatgaaaataacacagctgatatttttagcaagattcttggatatagctttagaaataaactagccagaaggagcagtatggcaagattaccttttctttatatcaattagacatattgtatcgtatgacttatttagtactgaagatgtctgtgcctttctgcagttgtttttcatctattaaaagagaaagatactatctatgctatcttttcaagatccctgtggatttgaattttcaagtgtatagataaaccttgattgatgaaaaattgatggacaaaattaattttataacaaaggtaaagaagtgagtattgccttcataatgtgccccacagcttttaacagaatttctttaaacaatatttaatgtatttttaaacaattatatatttcaatattaaatcttaagtatgtttcaggaatatcttctttaagataattgatatatcccagttttcatacgttttaaattttttacgtctacagtattatattttcttttgaaaaattgcgtaacattaaggtagtaaataaaaacaaaaatagtttaatgtctcttgtgggaaatacagttttgttttgttttgtttgtttgtttgttttgagaccgagtttcactcttgttgcccaggctggagtgcaatggcacgatctcggctctccgcaacctccacctcctgggttcaagtgattctcctgcctcagcctcccaagtagctgggattataggcaatgcactaccatgcccggctaactttgtatttttaatagaaacggggtttctccatgttggtcaggctggtcttaaactcccaaccttaggtgatccgcctgcctcggcctcccaaagttctgggattacaggcgtgagccaacgccccctgcctagttgtttttgaccacatattttttctctgaaatataaatgatttgtagcccaaaagtttaagtctgaatcaattgtctgtagtaaatgctgcaccatctacatttgttaatgagaacaatacagaactaacttgaaaactgctcaaattttcccttgcataatgctcagtttttaaaatgtattgccttctgtcttctcaatgggattgctgctttttaaattttcattaattcctaaaccatattccattgtattttttttgtacatttgctttaagtgactgtctattggaggaaaagaaagtgtaggttttctggtgaattataatagcaatatgattcctggaatgaagcagcttttctcgtttggaatgaccataaaatggcaatacacttaacagtaatacccttgtctgtgttacagcaatgggtcttaatggttttccatacgtgaacttagccgcttgcctacagagaattactaagtaactagtatattccacatgtaaaaatctccagagggcttccacacactttaatacacgctgatatacaatataaatgcaacgtatcctgaagaaaaaaaaaaatcacaaactccgtgtgtggctctcaacaagctactattttctcattagaaaaataggaaagctggccaggtacagtggctcacacttgtaatcccagcattttgggaggccaaggcaggcagattacctcaggtgaagggttcaagaccagcctggccaacaaggtgaaaccccttctctactaaaaatacaaaaaaaaattagccagtcttggtggtgggtccctgtaatcccagctacctgggaggctgaggcaggagaatcacttgaacctgggaggcagaggttgcagtgagccaagattgggccactgcactccatcctgggcgacagagggagactctatctaataataataataataataataataatagtaaagctaataactatacaatatcttacctaaatgtttaagaacacctactaataatacttaaaaataccaaaatataaaaacaaaacatacaaatgtaaagaacatacagtcagtagtacagcaaatctatttgattacttttttcaaaattctattttaatttttttgctaattttaaagcactgttattaaaagaaaatattttcaattggttttattctcattgtatcttctagaaatactagttcattttaggaaaataaaaatagtgagagaaaacttttagctctgaatatggaccatgtcccatgcctgccactttgttctagtttttgttatttaattatcacacactataaaggagttcttaccaattcttttttttcttcagaaataattgattcttcagttttttaaactgctttattgaggtatgattggcatatacaccaattctcttttataggcaatgaaattggagatcagaaaaaattgagtaacttacctaagactacaagtaagtggcagagctagaatttgaccccagacaggcttcacatacaagttcacagggccatcagctgcctgaaggcagagaccatgatttgtatccatagtatttatgtatctctcatatctaaataaaatctagtcactattcagatttaattgatattttcaattacctttgtatttttaaaagaagacacattatagaaatttgatactaaatgtaagtattcagttctttagttaaattgaagaaaagcagaaataatattctgtattaatacattagtgaaaagtcagcagctaaaatgtaagagatgtttggtgacacaagtaaaaatggattgtatactttttgccttatactacctgactctggcatttagatataacttgttccagagacctgtcataacttatatgtttcagacaagaaaagctttgggttacctgaaatagtgtagttaaaaatcaaacgctgtactcatctagagggactttgtttatccattcaaaaatacatgaacagggctttatcttggcctatttgaactccatgccagagggcagcataacatagcaaagcatgctgacctctccttatcactgcccttgttgaaaaccttgagttcttcttaatagtctggtatatagttttaaaatgttgatattttgttcacagctatatgtgatctcctaaacctttgcttcaaaatagtctatttctctgttgtggtttgcttcagggtaaaagccctctgatttcccacaatcaggacagtaatttggtaggttaataagttatgttgtgtgttagtgaaatataagtgctaaggaaaataaaagtagtagggcaagggaaatcaggaatactagggcctggaaaagagcatgaaataatgtgttatgatgagttgcactgagcaggttaaatcagaacgagacaagaagccaactagatagagaagattgttccaggttaagggaatgagtggaaaaaaggctctcaggtgagagtgtgttcaaggaatagcaattaagactgtgactactggccaggcgcagtggctcccacctgtaatcccagcatttttgggaggccgaggcgggcggatcacttgaggtcaggagttcgagaccaacctggccagtatggcgaaaccccaactctactaaacatacaaagattagccgggcgtggtggtgcacatctgtaatcccagctactcaggaggctgaggcaggagaatcccttgaaactgaaggcagaggttgcagtgagccgagatcacgccactgcactccagcctgggcaacagagtgagactccctctcaaaaaaaaaaaaaaaaaaaagactgacttttataaggaagaaagtagtaagagatcataaaatcaagaggatttggtggtacagattagagacttgtacgttttcgtttctgtgcagtagagaaagaacacagagacatttgcaaaacaatttaagaggggattccttcaatacttttctaatatccctctcccaaaggcctgtttattcttcagctaatttttactgataatttgtattttttagaaagaacgcatctctttattttatagtcatgtatcatcaaattatgtagtatataattatattagatcattacatgagcaggaatgggaacaatcacagttgattcttgctatgttccggttatctattgctgagtaacaatttattataaaacttaatagcttaaaacaccagtcactttttatagctcatgattttgtgggtcataaatttgagcgtgggtcaactgggtgattttccactctatgtggtatcaacttgatccctaaatgatactcagctggcagatgagctggtcagcagaatccaagacagctgtactcatatgtatgttgctttggtggagacgacagggagacttgggtcaactagatctattgactctagtacctacatgtggcctcttcagcatggtagacccaggattgttgaacttatcacatgggagctcagggttctagagtgaatgatacaaaagacggaaaatataagtttctggtatcttcaggcctaaccctggaaactagaacagcagctctttcactgcaggggtccccaacccctgggccacacaccggtacccatctgtggcctgtgaggaacccagctgcacagcaggaggcgagcggtgagccagtgaagcttcatctgtatttacagccacttcccattgctggcattactgcctgaaccctgcctcctgtcagatcagcaatggctttagagtctcaggagcacaaccctattgtgaactgcacatgtgagagatctaggtcgcatactctttatgaggagtatcaggcaatctagtgactgatgatgtgtcactgtctcccgtcatgcccagatgggaccgtctagttgcaggaaagaaagctcagggctcccactgattctatgatatggtgagttacataattattttattatataatacaatgtaataataataatagaaataaagtgcatgataaatgaaatagtctccaattatcttaacactatccctcacctcccccccactaaccccagtctgtgggaaaattgtcatccatcaaaccccagtctctggtgccaaaaaggctggggaccactattctactgcattctattagagcagccacagaacccacccaaattcaagggaggaaacaaagactttacctccccagtgaagaaatgtcaaaaaaattcgcagctatctttaatccgccaaagcatacgatttatctctcatagagagatttctagttaaggtttttcagcaggtcatcttgatccatagtaaatctaacaaagggaatggagagctttggttaatctaatgattcagttaaatggagatccattaaaatagattctactataattccattcattatttttcacattttttctaattttttattattcatagtgtttttgtccaatgacctttaaaatcatgaacatttaatatataggaatggcatccatctgaatatggcataattataaatgaatttactttaatatctagaaaacattcttgttcgttctctaacttttagataaaagccatcccttcttttatttaatttaactctactttaaggctttaaaaacctgactgatagggaaaaagtccaaaactgggacgctcgtgtagactatttactgcaataaatcattgtgaaaaatatgggcagtcaagtgctggatattctatttctgtttgaaccctaagaaatatcaaccgtcttctcactggcttttagcacatctgctccatttaaaactatggcagggaggtgtgtaagattgaattgattgtctcttggagtttactgtgcttctttcgaaactttgtttttcagtaaaggcaattgcttcttgagcagtactggttattccacacccactaattatcatgcagccatttagagttgaaatggtaatcaaaccaatgaaagcccaagattagcagcgttccttcttcatttctggtagagagattcatctgaatatctataaaggattttgtggtgcattctctggcagatgcagtaaaacaagtgcaacatgaactttaaaatacagctttgagttttaggttgaattttaagttgaacatatttcaaattttgcaatttaattataggagttaaatgatcttaaaggatcattctaggtctgaatagaattttaagagctagattttattaaagaaaagatatattttaagtgataaaatttatatattttgcccttcagaaattactggttgatgtttctattaaaattattaagatctaaatatacaatgatactcgagaccaattctcatttaaggaatggcatactgtatgacaggatgtgaggtgttaagagataattacatgcctagaaggtgtagtgaatcatatgaccaaaagccaagaacatccagagaccaaaattcacagtcatttcaaatatcattactccctggtgtgtgttattctacttagaaaattgcatgtttgttgtttgtaaatttagagacaaaaaatgcttaaattaattttttcatcatttctaaaaatttgctttaatatttactagcccagtaaaatgtattcaaatcataattataaatatcagggctattgagcaggggaatgtgtcaactgccattccggaccttcttctggaactaattttgattgccagcagaataaaatgcatgcaatgaatacaatgaatgtaatgctaaatcaaataatcaagtgtttatgtttatgtattttgatccccctatacatttaaaataactctgttttattagaagttctgtatttgagataaaatgcacctccctctcatttttcctggtttgtatgtgagaccacagtatttcacagtagatatccagggaaataacagacaaaagaaaggagagcaggaagaatattttaagatttattggccagcggcggtggttcacgcctgtaatcccagcactttgggaggctgaggcgggtggatcacaaggtcaggatgtcgagaccatcctggctgacacggtgaaaccccgtctctactaaaaaataaaaaaattagccaggtgtagtagcacacacctgtagtcccagctactcgggaggctgaggcaggagaatcgcttgaacctgggaggcggaggttgcagtgagcagagattgagccactgcactgcagcctgggtgacagagcaagactcgtctcaaaaagaaaaaaaaaagatttattaatttgtcttcaacaaaatactaactctgcagtgccctcaccttgattccttacttattgaggactaagcctatttttgtggattgaaatgatgttaattatctgcatccaaatacccctcataggggcgactgtgagcacgtccctctactagtaacacaatactcaggtgagagctggcaaacacaggaagactgaaaagcccgacttggaatcctgacttctacattttttaactgtgtagttctgggagtttcttaaactcgtgtgcctcagtttttccatttgcatctgtagaaagattgtaatagaaactaccttctctgttataatgattatatgagctaaagcatgaagaaatataaagcagctaaccctgagttagctctcaagaagtattttattattaacttgttaataccttcaacttataaaaatttaaaaattatgaaattttttaaattatgagatttacataaagttttcagaatagtctaatcaatacagacagaaagtagattagtagggcctggggacgtggagaaaggagagtgattcctaatgagtatggggtttcttttttgggctgacgaaaatgttttatattagaaagtggtaacagttggccaggcgcagtggctcacacctgtaatcccagcactttgggaggccaaggcaggtggatcacgaggttaggagatcaagaccatcctggccaatatggtgaaatcccgtctctactgaaaatatatatttaaaaaaaatgagctgggtgtggtagtgcgcacctgtagtcctagctgctcgggagactgaggcaggagaattgcttgaacccaggaggtggaggttgcagtgagccaagatcgcgccgctgcactccagcctggcgacagagcgagactctgtctcaaaaaaataaataaataaaggaaaaaagaaagtggtgacagttgcataactatgtgaatatactatatatcactgaattgtgcactttaaaagagtgaattttgtggtgtgtgagttatagctcaataaaatgattttaaaaaataaaatgagaaggatgagagaccggtatatttcagaatagtgcacttaaaaaatttgtttacagaacactaattgttcagcatactttctactggacattactgtatatatatatatatttagtattatataaatacattatatgataaccatatctgataaatattatcttactttatagatgatgaaactcagatcttcaatgatggaagtgacttatctattgttgagttgtaattggatcttatatatatttccctgctcccacagagcctacatttctgaaaaagaaattatgtctcttgtgataaataaacaagaaacatatcagataaaagtgttgcattgagaacaaactgagttgagatagtgagtgattgggtagttattccagcttcagtagtaaagagaatctttgctgaagaggcatgtcagctgagatatgactgtctagaggaaccagtcatgtaaaaactgaggaagaaccttccagaaggaaagaatagccagtgctaagacactgaatttcttatattttgtgtttagaaatgctagggttatagttagcaagatagcctggaaggagccttcccatgttttctcatatatgaaataactaacatggaggattattgtgaagttacaaaaatacatgaataacacctagtatagtatctcactcgtggttggtatataaaaaatattgctgttctattaattcctcaatatatagctattctatacaggtcttatgcaaaaaagaaccttagtgaacgtatttcaacttggtaagagttagttacacatgggctgacacaatcataagcatggaaaatagacaatagattgaaagcattaacaatggtagttggaacttcagaaaaacccactctttcttaatctatgatgaaggaaatggtgggttttccagtggtattgaaataaaaggaaactttttagatggtggagtaaggtatgcaaaggtagcgagcgtgtgcatctatggctggagagaaatccaaagacaagatagaatcacccttttgctctctgtgaaaactctgattttcctttcatggactaaggtctacactctccaatcatcttagttgcatacactattaattcatcaatcaagctacgtcatcctttgtgatatgttttgtttttctttcttctttttaattattgtgggtacgtaagagttgtacatatttatgaaatacatgtgatattttgatacaggcatacaatctgtaataatcaaatcaggataattggaatattcattacctcaaacatttatcatttatttgtgttgggaacattccaagtctactcctccagttaatttgaaataaacaattaattattgttaactataatcaccctattgtggtacagaacactagattttattcctactagctaactgtatttttatactcattaaacaagcccctcttcatcaccccctccccactacccttcccagcctctggtaacaatcattccactttctacctccatgagatcaattttttagctcccacatacgcgtgagaacatgcaatatttgtctttctaggttgtgttttgattagacaacctcttatttctaaaatttgcttaaattatttgagtacttgatccttcacattactgccaataaagcaaaccacagttgaaacttgatttttttctaatattttgaatgtatgctgtgtgcaaaggtaacaaagaggaatccatttaacagaaaacagattgctaatatcttcatcatttactttagattccagtctttggatatcagatttttctctggtcttcatatttatttgttttggcatcagattgcattttcttgcttggtttaaaaaaaactgtatttttttccctgtattatcggtgttgatttcctctgttcttattcttcaaattatgcagagaaatgtgtacaaagttaggaggagttaacgctatataaaataaactatctattaatatcattcggttaattttcaaagaggctgtaaatagatcatggatataggcaaataccagatgccacataaaaggaaaacctcaaagacattttttcttttattaaaaccatcaacagtaagaactgtgacagtaggttttgggtttttttattgccaaggttattatcagccctctaccctaaataagggaataaaatgatttctagtttttggacactgtgttatattattctgtaactacaggaacataatataatgctacagtcaaaagaataagcttagaaatcatctaagtttaaatttgtcactcattttctagaaggatgaccttatactatctatttaacctttctaagactcaattgccttataaataaaatgattataataaagacttcataagttgccatgagaaaagtattaagcacagtttctgagataaccaatattgataataatataataatcatcacaaaacattacctttctccttgtaaaaattataacgttaatggttttaaaaatgtaattctagtaccaaagtgaagtttgtattatgttctagttaatatatataaaaatttaaagaaaaactaaaatacatatagctgtgaaaatactcactaaaccaacatagaaaagcatttgttttgctctgtaaatctaaccttgatgattatgataataaaaataatcactgttaggttattttacttgtgattaacttctatttatgtaccctccctctattgatgtttaacaatagttcatagctatgactatttcatttcatatggctgttcctaaaatcatactgaacatctgactccatattcttaagacaacttgggacctctatctcttccctgcaacaatatttgtgagttgacaaacataaaagcctatgctttagcacgcacaagagatgtggaaaggtaccatttaaattagtaccataaattttcctttttatgtttcctaacctcatatttattgaaatgcattaaattaactcagacatctaaggatataacatttaatttacaataatctttatggttacttaattccattaaccttatctttgaaaggcgtcaaattaagaaatacagagcctgtcactttcatttattcgggggaggctgtgaactattcagatgatgtatctttgattgagggaaggaggtgcccaagaattagtcaattacgcaattaaaaaccccaaacctttcctttggtatgtttcacacaaaatctccattgctgtgctagattacactggatgatgaatcactacttgaatcacttcagttttgattattcaaagtaaaaattgaatggttggcattttcaccaatttaaaagcctcgccgggcacagcggctcacgcctgtaatcccagtactttgggaggccaaggcgggtggatcacctgaggtcaggagttccagaccagcctgatcaacatggtgaaaccctttctctactaaaaacgcaaaattagccgagcatggtggcacatgcctgtaatcccagctacttgggaggctgagacaggagaactgcttgaagctgggaggcggaggttgcagtgagcggagattgtgccattgcactccagcctgggcaacaagagtgaaactccatctcaaaaaataaaataaaataaaagccttaactttcattttctcaccagattttagcttgacaaaagctatctttaagggttgcttaggcatttcagtttgaaatgtttatgttcttgctataaaatgtgtggacatgtgtgtccaaatatatacacacaagaaattttaggtactgtcatagtgttgggatcattaagaattgtgttttcatggcgagtaaattaatttcctctgctgtgagtcactttttggtagtgtatgcatggtttaaatgaaactcactgaactgtttttgtggattcactgcttggttgttttactaccctagagagcaattaggtgtatgtggagtgtgttgaacctataaaattttacttgtgtgatgactgcaaagaaaatgaaagtagtgtcatgcaatccatgaaaactctgctgagtttctagctagtctcttaataaagtttacacaattcaaactctccaatcatactgaatatcactgaggctcttaagacttgtgaaaatcagatattttaaatttttaaattgtcatattatgtcgccaatttccatttctactctatatttatagtacttttttgcattttgagtgcacaagtcaacccgtttggccatacatagcaagacatgtattggtgagagcagcaaaaaatatgtaactgctcgtttacaacttttgaccagtagcgaggtcacactgagagtaccgctcaggagaattgagtcaagttttaggctactaaaatttgctgagctctgtgacctagggacatattcctgactccagcaggcctttgaagaaatcacgctggcaacctcacaatagatgaacaagaaaatggatgaacacaaccatattataagaagcagttatcagacgcatgggttctggagccaggctgtttgctgagttcgaatctcagtgctgctatttaatgactgtgaccttaggcaagttgcttaactctgcctctcttaattttggaaattaggaaaagaactacttacattttaggtttgttggaaagatttatatcacttaaaatgtatacagcatgtaacaattattgaattatacttaacaattattatctaggggaaaatatactgatgattttgtatattgtatatatatacacacacgtatatatcagtaactttaaatggggaagtcactaaaaaaatcataacttggtgtaaatatacttaatctgtatgccacggctagttttttgtttgtttatttttgccaagtttctttaatttctgttggccttttggggtcaccccattagcatctgcaggatagcttacttatacaggggaaagtgtctgttaccagtacagtacagtggtggtataaggaaaatctattaaatgaagtcctgggtgtttatccctataattgcataaatgtatgtttctcaggagtagtgttgtgtaagtaaatggataaaagtcatagagtgctaaagctaaatggaaacaaagttatttagtccaattcccatattttatagatgagaaaactgagaatcagaaaatggagggatttgttcaaggtcatagtagttattgtctgagatgaggaaaatatccaaatgtctgcttaaatactgagatatgcttaagttagcgttgaaaatattccatttaaaatagcaatattttcttcctcctgaacatctttgtactatttagaaaaacctagaaagcatgctggaaaactatccctttttcccttgtcaacctccaattaacacaaaagcccaaactgtacactgtcccttataaaaacaacctaaaattttgagaataacattcataatcttaaaagaaaattacctacttactacatatgctggcaatgtacttgctgggcaatcccacttgaaattcatagaaattaaacagcatttcagaacatcattccaacacctaattaatgacagggagtgactgctgactaaagaatgtgtccatgatactttcaatttatagcaaaaactcttaactattgatagcagaaatgtgatatataaggatcttgttctgtcctttcaaaagtcaaacagaaccactgtcccttaaagctgatcggcaaaggaagaagctgggagtccaaaggatttatttatacaaaatatgtatttccctaatgttcactttccaactttgattagacattttttttttttttttttttttttttttagcgatggggctgtattagtcaattctcacactgccataaagaaatacgcaagatgaggtaatttttaaagaaaagagtaattggctcaaagttccataggctgtacaggaagcataatgctggcatcttctcggcttctgggaaagcctcaggaagctcaaaatcatggtggaaatgaagggggagcaagcatgtcatgtggccagggcaggaacatgagagagagagtgggaggtgtcaaacacttttaagcaaccgtatctcatgagaatacactcaccatctgaagacagcaccaatgggatgatgataaaccactcgtgagaaatccacccgcatgctccgatcacctcccaccaggccccaccttcaacactgggaataacttaaccgggcgtgatggcaggtgcctgtaatctcagctacttgggagacagacgttgcagtgagctgagatcgttccactgcactccagcctgggtgacaagagtgaaattccgtctcaaaaacaaacaaacaaacattggggattacatttcaatatgagattatggcagggacaaatattcaaactatatcaggggtctcgctctgtctcccaggcttcagtggcaccatcgtaactcactgcagcctggaactcctgtattccggcgatcctcccacctcagcttccccagtagctaggactacagttgcgccaccacatctggctcatttttgtagaaatggggtctccttatgttgcctgctttggtctcaaactcctggccttaagtgatccgcccatctcggcctctcggagtgctgggattacagacgtgagtcactttgccctcccggactggttttatgtgtgaaggaggctgctgctgatttcatgagtaagctggagaaacacattaaggaatgatactgtccccttagttgtcaaccttcaaaataggaaacaaataatagcaaagaggtaaacgtggcagaaagcaggggtgagaaagggaacaatcagatatgcgaaacatcaaagaacaagaaatagcaacaaacccacgccagaagccagcaagaaaaggagaactgttataagtaccagtaaaaatgctgaagaatggcaataaaaaggagaaaaaagtactcacaagggaggccttgaaatgacaataatctattccaggatgaaaagaaaaggaaacactactccaaggcaaaaagaaaataaaaagtaaggaaaatcaagatagatgaatatcttcaaaaaatcagcacaatggagatagagtgtttagggaataagaaaaaaaataaaagtagacagatacagaaagaagtagcaaatgcaaggagcaatatccctattattaatgctggcaaattgtacttatatctctttccagctatatagcatgttcctgggaaatagcctaaagcactgagaattagggataggagaatgctgttactgtgagaatacgaattaagtaatgccagagaaaggctttgctgccaatataatagctgagtgatcaggccacgtcatttctgtctgatgtttcttcctgtcgaataggtaatagtattatttctctaactcaagggacattaaaaaaatattcagttaatgtatatataaatggagacaatatagacagatgtttaagaatattttggttaaaaggacagactcaaagccaaactttctgggttggaaatccaactctttcattttctctcagtactgtactgtaggactctctttttatacactttttttgtactgtcttttttatacactgactctcttttttccttagtttcttcatctgaaaaatagagttaataatagcacctacctcataggattgctgagatgagaaaattaacaaataaaaatcacttagaccagtacctatcacatagcaaggaaaatctcaactatattcattgtggtgatgttttgttaataaacttttaatatgaatgtaacatatcacattcattaatatataggaattatatttacttacattgataaaagtcctatctgacatcatcttctgttccttcattatttttcccttcttcctcactttttcagttctgtctctcttggttcattccaaaaaagggtcatttcttttttgcctcaactgcagaatgcatattatttatcaagcaattattgagcacttaccatatacaggcactgttagaaagacatctaaggcacaattttttagtgtgctgaaatagttattcattcagcaaaagaaggagctcataaaaataaaaaagaaatgctatgggtaaatataagaacatggtgatttcacttggtcctcttggatgtaaaaggaagctttaccaaaaatgttaaaataataattgatggttgcagtgctgctgaattacatcaaactttctattgtctcacatttcactttctaatttgtccgttcctagtgaaactagaagctgaaaccacatttttactcatttctcccgttatcctccccccaccactataaaaagagaacatttatgcttaagtgcttctgatgatgtgttctcagtatctcattctgttagactaatagtcctcatgccaagttaaagtggttggaaatcctagcacaccttgcctaagtgtgttttatttatcttgctacaccccgttttattgtaatagtcttgggagagccccgaaagatggcattgacctatttctataaactttaagggagcaggggacgatctccctccataacaaattccaataaatgatgaggttaaaaattatagaaaggatatttctagagaggtatttttatgtgataaattttaatatatatgtatatagtttttaaacttgaatatataaaatatatactaaacttgtatatttatatatgtattaaacttgtaccacttaaaaattcttctgtagaaatatcttttctataatttttaacctcatcatatataatgatggtaattcttcgtacttcttactcctaattgtcttagttcaattgggctgctataataaaaatatcatagactgtgtaatttataaacaacgaagatttattgctgcagaactgtttctgcagcccaggaaatccaagatcaaaatgttggcagatttggtgtctggtgagggttctgtctgcttcacagatggtgccttcttcctttaccctcacatactggaagggcaaacaagttcccttggcctcttttataagggcactaatcccattcatgagggctccgcttatatgacctaatcaccttcttaaaaccctacctcttaatactgtggcattggggattatgtttctacatatgaattttggagggacacaaatattcaacccatagcactaatgaaatacagcatttttagagagcaatgtctactattttacaggcagcttgctactcgtgatgacaatacttcttcgatctagtatcccagcattgttccattaacaatgtatgcatcttaccaatgtaatgttcagtaaatattttgcatattttaagaggaatctgttgtggttttttttttttttttttttttttttttgagacggggtctcactctgccacccaggctgaagtgcattggcttaatcacagctcactgcagccttgccctcccagaccacaggtgcgtgccaccacgcctggctgatttaaaaaagaaattatttgtagagacaaggtctcactacgttgctcaggctggtcttgaacttctgggctcaaccacccctctggccttggccttccaaagtgctgggattacaggcatgagccaccaaacccagcctgattttttataatacaaaataatatacactcactgccaaaagtagaatacagaaaaacacaataaaggtaatagttgcctataattttgctattcaggaataaccagtgttacctgtttggcacagacattcctattgagaactatataatgatagctaatatttactagcacttggtacatacccatgtttcaattaccttatatgttaaatattatccatttatgcctgaaaataattttataatataagtactgttattagaccattttaaaaatgtgaaaattggtgcaataacaagatgcattaacttgttcagggtcacaatgccattataaaatggagccggaattctaaaccaggcattcaggctccagagcctaggtttttaaccactaagaataatacattttagtattttagcatacacatagttttggaagctgcttaattcacttaatatatcatatggttttccaacgtagttaaatattccataagaatgtgatttttttatgtctgcatataaatatattaataggatgtaccagaattgttttcatttctatttcatgaatatttagtttgcttctaatttttcacaatagaaatgatctagcatattttataaaatttttgagcagatgtacaagtatttagagactagtatttgtttaaataacacgtgttggacgttagtggggtatatatcaatgtgaaacatgaagtagatgtttgctttgtggtaactatgttccaggaacagtgctaggaagcactagggactggaaagctgtaaaaaagccagtctttctgttcttaaatatcttataatctaatggagagagaaacctgtagaatagtgcgtttcagtagaagcaagcttagtgtactgagaaatgaaaggcagatgatgaagtttggacaatggatggaaactatcttatcaagagttggggttataagaatgacagtaggtgatatgaagaaactagtgttttaagaagatatatgtggcagcattatagacatatggggatttagaacaggattatacctactgaactggacttattttatttctagaaattttgtgataataaataccatacattatatgttgttctcatataggagacgtaatatatgggtatgccattaatcaaaggctgattttaagtggaagaattcgttctgttggtttacagtcccagttataaattaatgggcttaccacgtagttgttcccagatcttggaagtattgaagttttttaaaaattaattaatttatttttaactgacaaataatagttgtacatatttaccgagtacaacgtgatgtttttgatctatgtgtatgttgtagaaagagtcagtcgagctgactaacatatctatcacctcaccaacttatcattttttgtagcgagaacattaaaaaatctattcttttagcaattttgaaacctataatacattatttttaactgtggtcactgtgaggtgttgaatgttttaggaaattctcagataatctcagggccaagtgttaagcagatcattctctgagactggatcttctgcagtatgtctgcgaacttttttatttcactctaagcctttgttgttgccttcaggggttactgactcacgtttaactcaaggctgactgagttagatatataccgcctatagttgatgggttttgttgccagaaatattcttttgcttatcagtggggaaggtttttgcttctactgctggatttaaaggtgtccctcaagattccattactcagttcattgagaaaagcttaaagctaacggaggggagttctgagctctgtttgatgaaggaggctgggtaaaataatagctcccaagttggctcaagttcttccagatgttcatgtttatgtaaaacttaacacttagagatattccatgttgtaagatgtctgtgcaaaagttccttatatcaaattctaaaatgatttttggtcatcaggtgcaaaaattaacactaatcatctaaaataaccaaccagatagattttcattctgtttgacttttgaaagcaaatacccctatgatattgagtgagtgttttattgtttgattttccttcaaacttgctgtaaccctatgggaaagatatgcaatcaaaataaaagaacagtatccaaaaataaatgggtcatgaagaattgtgcttaaaatcgttaagtaaacagacacacaccacagtgatgagattgtagaaactggaaaaaatgctgccagctgaagagctgcaaagagtttggcttttcatgaacttagttactgaaatgaaagttcctccctaggagagaagccaaaatcatagcacggtttgaataaaagtacacctttccaaagttactgcagaacaattatggccgggatcctttactcttattgagaaagctcggtaacctcttattttaaattgacttccattgagcaataatgcctccctgcttgcactgtaaggtactttattgggtaatgtgtttacaagctggtctcatttttctttttgtaataggagatgggtagcttactgctatttggaggtgactccaggaaacatgattttcaagatggtcattttaaaaaattgtgattattgggaataataactctagagacaagatttaatggacttacttccaatttattcagtatgtcaccaggttattgcagttctagttttaaatctgtacattcgaagtctacgttgttccctgatgtactgtatatttaggtttgtactactacatataggtgctaggtttagctccaactctcagcaggagcctaacctctcagaacaattattgtagccagatctttggtggccctactacttgctttttttttaaccactactatttctttaaaatcaaagatatggcaaacatattactaaaaggaagaaaacccatcttcaacaacattatggtgtttttcacttcaaaggcttattttgtatgcatcatttgatttaatttcctccaaagccttgggaaatgtgagtgattatcatcttattattgttgttgataaatagtagctactatttatttagcactaactctgtatctggaactgtggtaaacaccttgtagtggaaactaacaatagcctcaggaggctggaattgatattatccccattttacagacaacgaaatgtgatataaataacataacgtgccaagattatgcagctagtacataggagaactggaattcaagccctagttaaattgctttgacttcggagcctgagtgttgattgtctatggcatgttgccaagctattttatagctggaaagcctggtgatgctaaaagtttaaataccttgccctaggtcataaaattagttcccaatgccttccaactgaaatcccaaacattttttattacactttgttgtccgcaggactgctacccgcttatatggtactctttgaaaattaaacaaagaggcatcctccccacttcccaaatccacagaatagccaattttgaaagaaagcacgcttttttttcagtatgactctgctttattggaggatcacagggatggctggggggaatgtgggtatgatactcaagcacctttgtgcaaggtgcaatgcccagagccataaggagtggccccagttgtgctcatttaaaggaatagttggacaattctagataatattaagggagatatccaaaagagtttcctataagtatgtgctcttaagagctgtaaggaagtaaaattttgaccccattagttacatttctaacatgatctaacatcttcccttcactgccaacgaaaatgtttaagaagatataatctgacagcagttatgctaaaactcccctgaagccaaaatgtgtcacttctcaaaatgaccctcatcttcacaagcccttgaagaggagttgaggattatttatgaactaggttttaacctaaggtgatacattgtgctgcagttgttactgagcttagggatcattttgtctattcatttcaggttaccattaggttctttttcaaaatcaattccttttaattatacagctaccctgggcatatattaaatgtcttacaacattgatacgctttcccctgaagtactgacaaagtaatagatttaatgcgcaaccacaggcataaaaacccacacacagtgtaagcatacaatgagtacactgatactcacaaaagaggtttaaaaaaatgtctgtaactggggatgtggtggtgtgagggccccatgaatttttagcttggaggatatcttatcgtaccgatgaaccctgaggatatgcatgaaaacaagctcctactcacaactttttttgcctgaatggtaagtttgtctgcagggcttggtctgattgatttgaaggagcatggtctagaaagtggttctcaaactgttggataacagaatcacctggggggtctacctaaatgtgcaaaggcctaagtcttatcactgctttaatgaatgtaggtctctgggtttataatgagctcgtcagttgattctgatgagcacctaatttgataacaacatgtcaatgggtacagattctcaaacttggctgttcattagaattgcttgagtctcatttctagagactctgatttcattgatatgaagtgcagtttgggcactgggtttttttcttaaagaagttcttcaggggattctaatatcagcaaagttggagaaccacgggtctaggggcctcgctacccgatgtgttgtccaaagaccaccagcagcagcagcagccgcagcagccccagggaacttattggaaatgcagaatctcaggtcccacctaaaattaccgaatcagaacccgtattttaccaagatacccaggtggtttgtatgcccattaactcttgacacacacttgtttagggagtcaggtagagctggattcttaagcacttccggttagttggatgactgaaaaacctctctgagctccaatctcctcacctgtaaaacgagtttaaggaataacattaccaatattgcaggtttgctgagaagattcttgaatgcaatacctgaaactcagtttaattcctagaacagtgaaaagcctcattaaatatgaagtcccggccaggcgctgtggctcacgcctgtaatcccagcactttgggaggccgaggcaggcggatcacctgaggtcgggagtccgagaccagcctgaccaacatggagaaaccccgtctctactaaaaatacaaaattagctgggcgtggtggcgcatggtagtcccagctgctccggaggctgaggcaggagaatcgcttgaacccgggaggcagaggttgcggtgagccgagatcacgccattgcactccaacctgggcaacaagagcaaaactccgtcatatatatatatatttatatatatatatagtccctactagaagagagtccctgtgaacctttttttacactagtggccccagagctaatgaggccaagccccaccaatgatcgtcgtcacagacattcctgtttttctgatatttataaaggttccttttaggtatgaggtgatttttattcaaaagaacaaatgttcccagatgccaagtgtcttccgctaaaaggataaatgatcagaaagcaatccttagctacagtgtccttgaaggtgcattgtggaatcttgcactgttgtgcaattgtgaacaacttcatcagacagtactgcgtatttgtactgtgttatccttaatttttccctttagatcttaatttgttatttatttcttccctggccaagagctaatttctttacagaaactcatatatagggttccttttttcctcctcaagtcagtaacttctgcaattaactacttttttcttaatttctctaactttggcccaactaaatattttcccatcattcctgttttgccgccctcgagctaggacatggaacttacttgttcggaaaagcttctatctgattgaaagggcatgctaattctttctttatagtgtaattgtttcacatttaagagggaaggagaaacgcctaaagtaataccacagaagaaataccctcaactaatctttctaagcagtacgacaatgagtaatgattacagttaattaagttaggcaacctccatttccattcacttagtagcactgctaattatactcatgctacaaggtttctttagttcttctgtaatttggatgcagtactctttgtagacaagggaatacggtacgattaatgagatttttcccaccaacacctcctgttctctccaaatgaaatttccgcatctgaaaattgagagtagggaacggagaaaaaaaaaatcagtcacattttaacttactgccagcacggtccatgcttataattgccaaatattttatattaaagaaaacaaggtgtgggtttttttttttgtttgaaaccttgtaaaattgtggcttacgtaaaaatgaaataagtatagaacatggctttttaaaaatatcagtggcaatgataatgacactttatattgtatgcttttggtcgcattaaataaacatatgttgagcacatactgtttgccgggcactggatctactaaaaaaaaaaaaaaaaaaaaaaaaaaaaaaagcaaaccttaactgtaactctggatttcttttacatgaacttcaatcattttaacaacttactctaaagaaaaccaagaactgcagctctacttggttatattgttaatgaagtccttggaaaaatttagtttatatgctttgatcagatggggattgacatacttaagagttttatttttaatctgaaaatccacttcaatcttatgctctgggtaaacagtcattacagaagcctgacacaattctgttttttcaagaagcaggattcaaggtttaacttcaaatacaaatttgagtaagttatacggattattccttttaattctttttttaaaacacagggtttatgtggatgaagtttcgttcttaatctccatttgccttaagaattaacttctgcattgtggtttagattgagtttaagattgtttcagattttaaaatgtatttttaaaggtgtgtctggaggaagatatttgtatgtcaagcactgttggttttcataggaagttcaaatgtgttttcagcagcactggacgtttttagagttattttcttctcctagcatcacacaggtgcgcaactttataggtccagtctcttctttttgcttccttctctgcttctttttctttttcactaacaccagtttgcataaatgagtgcactgtcgagttcacgtgaataccagacaaaaatacaggtgtcttcataataatcagctcctctaagtctactttccagtttctgcttcagactcagataaatcctatataaagcagacgacacagttatttctagaggaactgaggttactgattagaagggaacgtaatcaggtagattgagccggtgagggaagaaaccattgctgtgagaggggagtgtttgcaaaatgctgtctgtgaagctgaatctgtgagaacacctcactattcacggcaaccggagtggaagaaacaggtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtctcatctggtgagtaaaagctgcagataaatgcaacagccattcagaagaatgataaattccacaagcattcagaagcaggcttccctaaaggtgactcttttggtcaatttgcaacccctgggatatatttggatgactcctgttccatatgcctttctataaaagttaaattggggcttttgttgtgaggaagggaagaaaggggtttgacaccaataacctataggataatgcaaatcactgaaataagaaggaacccatattctactttttgggttgtggctttaatgaactttgtcttcaggtatctaaaattatttctagtatgaagaaaagaaaaaaatatccagaccttaatctataaacgataatatttttacctcaaattaaatttctaaggacgtagactacattcataaactcattagaaaactaatgagggatttttatattaacaatagaaaaacctgtgtttcacatatatatatgggcttatttatgcatatatgtacatatgaatatgtgtatgtgtatatatatacatacacatatacactcacatttttaagaagtttttaatcaaagaagacggaaataacaaggatccttgtgaatagtaatttagacatgtttagacaagcacaacttattaggaagcaaactgggacaattgtaaacagtaattccaggctgcctaattatctgaaatatctcagaatgattttagaggttaaacacttattattaaatggtagcttctaaataaagtgaaaaggtgtagtgatttatcaggtttttttttaattatagaatatcctaaaattctaaattagcatatattctgttgccaatatatactgtcagtatatttgaagtatattaatttctaaattatgttacttttattaaaattccaaagagtttctgacttggacaagttttctctatctttaggaagacagctagtttttttttcaggggggtgagctaaaagagttaggataaagtacaccgcattaaattaaaaacgtgtgttgggaataaagacaatccaaagttaaaagtctatttggatctcaaattttcccataacttgatttgtaagaaaagttacccttttgcaagtcttctctctcatttggtctggactaagtggttgtcatttctcacttacagattgctgttttactaatctctttataaatatattttttaattttatatctgtattttattcatcagattgtcctggaagtacagaggccagttgatggtttatgagttcaagctgagccgaatatagctaagccctgtcttgcctgacatttcatcaaaagctgtgttgatttgcaatgtttaccgacctatttattgaaccttcacagcttgaactatgccaccaagctcgctgacattgctgagattatctctaaatgcatgtacaaactaaggaggaaattgaaaaataagttaaaaacaatcatccgtctatttattaaattatgcttatagagtccttgatttatgtatttgtttgattgttctccgcaaagccccatgacctgatttttctttgatcttcccacacactcttggaagacgatagattagaacagtggttctcactcttccttgagtgggcatcagattcacctggagggctggttaaaccacagcttgctggatgccacccccagagtttctgattcagtccttctgaagtggggccccaacctctgcatttttaacagattttttaggagatgctgatgctgctagattactaagaacagaaaatgagtgttctaatacaaagagcagaaaataattgttcttaatctagttacctgtgttctctttatgcgttgtttagtttacactgtacaagaaaataaacacatatcctcacaaaattgaagcatatattctactaaagattaatatattaaaatattgaataaaatattaaatatctatgttaggaaattgtattcctgctgaaactggcagtaaaattacttaaattacttagcagtaaaattactgttgacaaaagtaaacaattggtcattaggtctcaaatacgtaaaacctcaattttttttttttttcttgagacggagtctcgctctgtcacccaggctagagtgcaatggcacgatctcgggtcactgcaacctccacctcccatgttcaagtgattctcctgcctcagcctcccaaaaccctcaatttttaattactcctttgattcttattctctgcgatttctccctatgtaaagttttagtctattatatttttagtaaaatgaaagcatgatccatgagataagcacttgaatctatactatacatcaaagtctccccttttgggccattaaaactaagatgttttccaacttaccttaccaaagccacagtttgaaaactgaaactatgaaaaaactggatattttgcttaattataatgcttcgtaaaaaattagaacgtctttaaaaatgttaacaactaaagtcaaacattcaaaaattataacctttgctataaagttatatgttcattcattgtagtcactttcttttagtaaaatgtaagcttttgatgtattctaatggggcgcaacgtttagattaaatgtttaatatggataattgacttttaatgaaatttaatctagatgttcgtaactgagagttaggggtgaacatgcctttaaggatgtagacatttttattacaattattttctccatgtttttgattaaacatatcaaggaaatatatattattttttatttaacttttctaatgtattaatttttggccagtcctacctatcacatgcttcagcaataatcagagctttgatgacaatgtcacattattttaattcagatgttattccagtttgataagatggagctgatctttagaaaacaagtgtaccatatttctaatctttaaatattatattgaattatttcagcctggctcacttgccagtttttcccttttgttttcatgattaaagcaactgataattattaacatagataagatttatgacattaatttatggttttcttcataaaaataaagccttttttttttttttttttttttttttagatggactttcgctcttgttgcccaggctggagtgcaatggcgagatttaggctcaccgcaacctccgcctcttgggttcaagcaattctcctgcctcagcctcccgagtagctgggattacaggcatgcaccaccacaccaagctaattttgtatttttaggagagacggagtttctccatgttggtcaggctggtctcgaactcctgacctcaggtgagccacctgcctctgcctcccaaagtgctgggattacaggcgtgagccaccgcacccagccaataaatccattcttaacggaattttagagcataaatctgagaaaagaaactaaggctgtacgtactaggtctcctatacaccttgtctttcatcattgaatccttagtagttaatacctgcttggaatgtaatgggaattcaataaattaattaaataaatggatgagtgaatcctacagacaattttgccaaggaagaaaataaagacagggtatttttatttctttcggttttttttttttttttttttttttttttttttttcagacagagtctccctctattcgcccaggctggagtgcagtggcacgatctcggctcactgcaacctccgcccttcaggttcaagtgattctcctgcgtcagcctcccgaatagctgggactacaggcgcctgccaccacgcccagctaatgtttgtatttttagtagagccgaggtttcaccatgttggccaggcttgtttctaactcctgacctcgtgattcgcatgccttggcctcccaaagtgctggggttacaggcgtgagccaccgtgcctggccagggtatttttatttttattttatttttttgagacagcgtctccctctgtcgcccaggctgaagtgcaatggcactatctgggctcactgcaacctccgcctcctgggttcaagcaattcttctgcctcagcctcccaagtaactgggatataagcattcgccactacgcccagctaatttttttgtatttttattagagacagggtttcaccatgttggccaagctggtctctaactcctgtcctcaagtgatccgcccacctcggcctcccaaagtgttgggattataggagtgactcacaacgcccagccttttatttcaatttttactgctgtttgttttcttccaaatgaataataaatatgacattttattctgatagctattagattatgaattgaatgtgagaacaaaaggcattctggttttcgtttgttttaatattggactgaaaaaaaaaaaaaaaaactcatttgaaccgggcgtggtggctcatacctgtaatcccagcaatttgggaggctgaggtgtacagatcacttgaggtcaggagtttgagaccagcctggccaacatggcgaaaccctgtctctcctaaaaatacaaaaattagccaggttgtggtggcaggttcctgaaatcccagctactcgggaggctgaggcaggagaattgcttgaacccgggaggcggaggttgcattgaaccgagatcgcacccctgcactccagcctgggcgacagaggtagattctgtctcaaaaaaaaacaaaagaaagtagaacaaaaactcatttgagactttcaggatacaataatttgtttaccttttcagttttctgattcctcatggtgaaggaatcatatctcttcagtgacacacaaacacacacaggatatatacagttatgtgttaacaccagggatacattctgatcaatccatactaaggtaatttcatcgttgtgtgaatgtcacagagtgtacttacactaacctacgtggtatagcgtagtgcagacctaggttgtatggtatatcctatttctgtttggctacaaacctgtacagcatgtgactgtactgaatactgtaggcaactgtagcacaatggtaaatatttcaatgtctaaaacatatctaaccattagaaggtacagtaaaaatcccgtgttataatcaaatgggaccactgcggtatatgcagtttatcattgactgaaacatccttatgcagttcctatcttttcttttgggccacacttggaattgaaatggaagctggagaaaggaagaacatgaaataaactgatgtttttccagccagtcaaaactcagcctctgtgttttagagaaagcattcggaacacagttgagagagggagagaaagagaagtggaaggtttagagggaggtccccgcttgtttttatctcttcaagcagctctaaatttgtccaaagcagaaaaagttgtacttcgcttcactctatattcaagactcaaaccaagattaaacatgaacctgtgggaaagttctttttaattaaactcatgttatttgaaaatacattatggtaagatatttttttgaaagttaagagtcagattttgtctgcataatgaaaagtgactaaggagtgctgaagttatcactcaattatcaggaaatctagaaaaattactttccaataaaaatgagcatcaatgatttctaccacagccttttggttaaagagtaatgaggagaaattctgccatgtaattaaagataatgaaattatcaatcaaggctaagctgcattaggttctttgactaaaataattttatacaattttaagtataaattaagttaaaatatatacattgagtgtgtgcattaatgtagacagtgccaaatattcaacaaaattatttcaccacctttgatttttgttttttgttttttgtttgtttgtttgtttgtttttgagacggagtctcactctgtcacccaggctggagctcactggtgcaatctcggctccctgcaacctccacctccaggctcaagcaattctcctgcctgagcctcctcagtaactgggattacaggcatgcaccaccgtgcctgactaatttttatatttttaggagagacggggtttcaccctgttggccaggctggtctcgaactcctgacctcaagtgatctgcccatctcggcctcccaaagtgttgagattacaggcatgaaccaccatggccggctgatttaagcacctttggaatcataattattaatcataaatgaaaccaaactaaaaataaagtataccacatgtgagaacattccaatgaataaaatcatttctgtgtgagctagcctgctgttcaaatttgtttatgcttatgcttcagataatgtttacaaaagtactgacagattcctagaagcacaatttctaaacacttaccttggaggtttctagggccctaaaaatatttctagtcatttcaaaaaaccacaaaacaactacaaaaaatgtacttctcccaaaggccatacgtagcacatgcaaaaagagattctgcagagcattttggaacgtaagtagcttttgtggttctgtgtctcaaattagcctgttcttaaaagtctgcaaattaaaaaagaatgataggccaggcgtggtggctcacgcctgtaatcccaacattttgagaggccaaggtgggcggattacttgaggtcaggatgtcgagacctgcctggccaacatggtgaaaccccgtctctaccaaaaatacaaaaaaattaaccagacatggtggcatgcgcctgtagtcccagctactagggaggctgaggcaggagaatcacttgaacctgggaggcggaggtttcggtgagccaagatagtgccactgcactccagcctgagagacagaggaagactccgtctcaataaaaaaaaaaaaaagaatgataaattgagtcaaaattataaaaattcaacagacgctggcacagatttgagatttgaggaaccagtaaaaaacgtagtacatattgataaatggcaatgtggtgtcaagatattaaaattggttttaatcttattaaccaacataaaatatggaaaacttatacatttaagtgggcccagaaaaaagtttgcaaatagcattccaaaaatcgatagaataatgtgaatgctttgttttctaatcttcacataatagggttggactagatgatttataagatccagtatatagcccctaataataacccctttaaaaagtctttttttttttttttttttttttttttgagagagtcatgctctgtcacccaggctggagtgcagtggcacgatctcagctcactgcaacctccgcctccctgtttcaagcgattctcctgcctcagcctcccgagtagctgggattataggcacacgccaccacacctggctaatttttgtatttttagtagagacggggtttcgccacgttggccaggctggtcttgaactcctgacctcaggtgatccgcctgcctcggcctcccaaagtgctgggattacaggcgtgagccactgtgcctggcctaaaaagtgtttcaatagaggagagaaataaacaagatcctgaagggataagaagatgtaaaagttgttgctgatgttctgccgcatatttctttccccacccgagttccatgcagtatcttgctttgctataaacaggagtaagccagaaatatgaggggttgtgttaatgtcaccagaagcgacctttaactacgaggggatggaagtacttgaaaaaagcacgcagccatctcatcttctggtgcataattctgaggcatgttcctcacagcttctcagagattcaccagcaggactgagccccagaataatgtgctcattgacacacctttgattgcctccttacctttcctaatctcactttctctttcctctcacttgtactttttgtaatcaattgccagataaactgtgtacctgcacctcaaatccttgcctcagtgtctgtctggggagaatctaaagtaacacagaaggttagcgagaaattgtttcacatgcttaaacaaaacagggcaaaggcacttaagatgttagagggagggagggtgaggaaactcacacgggatgacttcactctgtttagtacctaaaagtgaacaggaggtggatcgaaaggaaacagttagtgaacctgcaaatcaataggaagggttagaagactggttatgggagatggaccagatagcccagtaagtgaagaaaaggctcatggaacagcagagaaaatggacatatatcatccatatattttgtttccatcctagtctaatttacccttagatactacaataatcccccaactcatctttgccacttgtgcttttgtccttttctactcactccatactctacatggcctaaaggttgagcttttaaaaacataaaccaggttgtgtcaatctctgattaaaattcgttactgctctgatgcgtccaatatctttaccaagaaccacacttcatttttcttccttttcttctgcagtcttgctgcatttcagccatactgacctgctgccatttctcaaatgccagtctctgtactgctattgcctcttcctggaatgctctcctcatccatcctctaactgccttgatcgccactgaatatacactaacatgcatattgtcagtcacgcagtagtagcttaatatgtatttgcggaataaactaatgggaaagagtaacagcatggttcagttgatggtggataatagtgatttactgagtcacaaacaacatcatctgatgccttagcaaagaggagtaggtattggagaaagaagacaatacttacaattctttacttccttgagctcattttatatgtgtgtgtgtgtatatatatatataaaacatatatatgacatatatgacatatttttgacatatgtcatgttatatgcctccttctctattatatatacaatgtgttcaaggaagtaaagatgttcaataaagttcaaggaagtaaagtctaaggtgtctttgtatgtagcactgaagtgatcagtcagagtccaggcttggctggatatcgaacagtggatgtgtgaagtagaagtgagtgatgccaattttaaagataatgagcagtttagtaggcaaggatttagtgtcagatatggaggttgtggttggcagtagtagtagttgtactgggaagctcttccacagtggtgaagaagcatgctgagaaaggccaaaaagtcaaagtagcatcttgctgtggataaggagattggcataaatggagtaaaagttgagggtgaaaagtgatgtgagacaaggacaaatagacaagttggcttggctaatgtaatacccatgatgtaagaaaagctatgctgagatagctaggctaattccaagggacttttgaggggagcatatcaggttatcacatgccaaaaatgtttcatttcagagactttagtcttctcattaattttatcgctaatccattcattttcaaaatgtatttcaggatttcacatcaggtcgactttaaatcttttgttcagatgaacgtttcttttcctaggactgagtaagacagtttgtcctatccagtgcttaagagtaaagcaagcttatgttgccactgcaggcaggattattaaataaccaattactattcagactgtgtcacatccctttaaattactcaagcaagagtcttggccgggcgcggtggctcacgcctgtaatcccagcactttgggaggccgaggcgggcggatcacgaggtcaggagatcgagaccatcctggctaacacggtgaaaccccgtctccactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaagagtcttgaacttgttcagcctgaacacatctgatatcctcagccaagtataggatgtaaattagatagcttctggctttactagtgtggaatcaggcatgctttttccccttaggactccatgactaatgacctgaattgtctacatttcaagactagtcagatctctaatggtgaacctatttcattgtttctgcttctgttttgtcccgtagtatatgagacaaaggatatttttatgtgcaaattgcaacaagttgagatactcctttaaaaatggattttctttccatagttgattagcgtatggtaccagatttcctagaaatgtttttatgataaaagtttcaggttctcgatgatgcaaggaaattacagacgttaggtaatgatttgtaatcaggacacatgagaggagttgtaactttactgcttaccctgtggctttgagaatcattaatcctcaatgggcctcagttttcatatctaaaaatactgctttttaggttcagttacttcaagggtcaaatgagataaaatatatgtgttataacaataaaatgtaataataaatatgaggtaccttttcccccagctttattgaggtataattgacaaatggcgattgggtatattcaaggtgtacaatatgatgatttgatacatatacattctgaaatgattatcacaatcaagttaattaatatatccttcacctcacatagttgccattataattttttatgatgagaacacttaagatctctcttagcaaatttcaagtaacaatagagtactattaactatagtcaacatgctgtacattagatccccagagcttactcatcttataactgagagtttctatccttcgaccagcatttccccatttttttccatccccagttactggctaccactgttccactttgctttgatgagcttaacttctttagataaaatgagttactttttgaaaaacaagtttaattggcaaaattgtatatatgtattgtgtacattatgttaaaaaatatatatatatataatgtggcctggtgaaattgagctataatagtagtgtttttaatgactatgtagccgaaagttccaaggctttcagctgattgactatgtaattcttaaatctagtagagtatcttctgatttgagagcagtatgaatcctggcagaaaactatgctggctatacacttttaagggtttgaactgtgttactttatctatatactctgcataaaatattctctctcctatacaggccagctcatttattcttgcttttctagtctgattccccctttctggaatctttttcctccatcgacttttggttctaaagcattcccatcttcaaaaattcaattcaagtcctagttaccacaacactttctctaacggcttgaaacacctcttttttctatgaacttttgttccacatagttatttctacccagttatcgacataattgcttgctaattatttcctgtggattaactttgattccataactttttaacttttttatagatttcctgagagcacgtgctgtgctttatatttctttgtaaatacctcagtagctctgcattttttttctctgtcatccaggatggagtgcagtggtcgatcatggctgactgaacccttgacctcctgagttcaagtgatcctcccacctcagcctcccgagtagctgggactaccagcgctccaccacacccagctaattttcgtactttttgtagagatggggttttgccttatcactcaggctgatctcaaactcccgagctcaggtgacccacctgcctcagcttcccaaagtgctgggattacaggtgtgagccactgtgcccggccagccctgtggttttttgtcgttgttttggtttttttgagactgggtttcactctgtctcgcaggctgcagtgcagtggcaccatctcggctcactgcaacctctgcctcctgggttcaagcgatttttctgcctcagcctcccgaatagcagggattactggtgcacgccaccatgcctggccaatttttgtatttttagtagagatgggtttcaccatgtgggccaggctggtctcgaactgctgacctcaggtgatcctctgtcctcggcctcccaaagtgctgggattacaggcatgagccgccgtgctcacccagctctgcatttttgaatcattgtttataaaacattgagcatcaaataatatgtttttaaatattgtataagtaatactgtgttcatagaaacgttttcttttggccgggcgcagtggctcacgcctgtaatcccagcactttgggaggccggcggatcacgaggtcaggagatcgagaccatcctggctaacacagtgatacaaaccccgtatctactaaaaatacaaaaaattagccgggcgtggttgcgggcgcctgtagtcccagctactcaggaggctgaggcaggagaatggcgtgaacccaggaggcggagcttgcagtgagccgagaccacgccactgagctccagcctgggccacagagcgagactccatctcgaaaaaaaaaaaaagaaatgttgtcttttacaaccatatatttatcatatttatcagtagtttaggcgtggtcttgaaaaggaacctccccctaccataatgcctttcgtttaggagatccccccattacacttgtggcttacattgaaagaaaaaaaaaattatccccttgtctatggtagaaaactgtgtcattcgtggctttgactgcatcacaatccattttagctttttgtcacttaacttgagaagaaatgaaatatatgtggagtgtatatccctgaagaaagtaaaggaccagctgttatcactatagagtttgtattgttgctgaaaataatctggttatgtttgtaaggattaagtagtttattcaacagatgtttggtagtaaacatgaatgagaaaaggcttgttcttatcatattcattatgaatgctgaggttgtgctttactacatgttttcaatgctcatcctaactgaaagtatgaagtggaaggatcaatttctgaatatttaaatgagatgttgattgccttgttataaacattaacaattttcctaagtgtttgctcttgagatagagcatctttaggagaactttatgatttgggctggcagatttagccaaattaacaggaatgtaccttcctaatgtgatcattcatccctaggaacaggaatctgggaacactgaggctatacttctgtatggtgagttatcaaagtgttaaacacaggcactattaatgaagcacagattctactttcagagtaaagctagtgttactatctatgaaaaaatattattatttatgttttcataataataacttctacattatatttattttcaactttttagaataaatctgagctaggaggttcttattttagttgttttccttctatcgtttttcattacgctcttgttgtttgatttggtctcacattttaaaaagcttactgtataagaaagttttatcttcaaaataatgagcactagaggttactataaatggaaatacaaaatgtggatttactaaagtgttttgacttttacctacacatttcttggagtaatttttaagttgaattttaagaattattttgctggccgggcacggtggtggctcacacctgtaatatcagcactttgggagtctgaggcaggcggatcacctgaggtcaggagttcgagaccagcctggccaacatggtgaaaccccgtctctactaaaaatacaaaatttagccaggcgtggtggtgggcatctgtaatctcagctactcgggaggctgagacaggagaatcgcttgaacccgggaggtggaggctgcagtaagccaagaacatgccactgcactccagcctgggcaaaaaagtgagattctgtctcaaaaaaaaaaaaaaataataataatattgccatatattcgaattacacaataataccagattgaggatattagaggaaaacaaatattatattttcaatatttctaaagtattttttgtcttggttatttttatggaattatattacatttatagtataacctaactcttaaccattttgaggggtaagtttaaagattaacttatcactattgacgaattattcatctacccgtggaagtgtctgcagtttatccatttcgaaacatctaatattacatgagaatttacttttctcattagattacataaacatcatgttaaaatgcaatatgtacatgtgacaactgatcttttgggaaaaaaaaagtccatgaatcactcctgtaacatttggaattaaattcattaaccaaaataatatcatgcttcatcttttatattttgcttccttagcatctggttcttagtctgtctaattacattataatggctctgtgttacaacagttgctagaagatttttttgggggggggggcaagaatgatgattttgcctcatattttggaatacctgctttgcaaatgtctttcctatatactagagccagaaggaaacaaatctaatgtttcttattcgtttgaaatttattgggagaccaacttcattcaaagatcaagaactctaaaatttttacatcaaaaactatttttttccccaattactttgttgagtactgcacttccagtcttgagatcgaaagtaatgttgaggccgggcacggtggctcatgcctgtaatcccagcactttgggcggctgaggcgtgcggatcacctgaggtcaggagtttgagaccagcctggccaacatggtgaaaccccgtctctactaaaaatacaaagaaaattagccaggcatggtggcgggcgcctgttattccagctactagggaggctgaggcaggagaatctcttgaacttgggaggcagaggtcgcagtgagccgagattgagccgctgcactccagcctgggcgacaagagcaaaattccatctcaaaaaaaaaaaaaaaagtaatgtttagccttgaaattgctaatacaatggacggtatccagcatatttcttttttgtatgcaattaatatttttactttatttattttatttatttttttgagatggagtctcactgttgcccaaactggagtgcaatggcgcagtcttggctcactgcaacctctgcctcccaggttcaagtgattctcctgtgtcagcctcccaaagtgctgggattacaggcacgagccaccgcgcctggccgatattcttactttaacagttgaataagttaatattttattggagctatgcaattagttaatttcatatagtgaatatattaatatcttatgaggaagagccacaattttagtataataatgtagataattataactcaggaggactatgatcaagatacactgtaaggatccttcaccatattttaccaaaatattattttatagttcaaagggggataggacggtacacttccaattatgctgcaaatttgttattattactgaaaaagtctattttcttcttcaagcaattaactattaatgtctttaatgtcaataaaccgcatagcgttatagactctctttgaatttctctgaattagaaataatttttgaataggaagattaacacagactcattttaattctgtaatggtagaaataattaatctccccttatctgtagggatacgtgttctaagacccctggtggatgcctgaaactgtggataataccaaaccttatgtatatattatgtttcttatatacatacacatataacaaagtttaatatatacattaggaaccataagagattaacaacaataactaatattagaacaattataacaatatactgtgataaaagttatgtgaatgtggtctctatctctcaaaatatcttattgtactgtactcatctatttttggactgcagttgatcatgggtaaccaaaaccatggataagaggcagactactgtgtattttattatatgcatgttatatataatatatgtaatatatattatttgtatccatttggcaaacaattgagatttttatttcatgtagttgctttttgtactaatatagttatatggttgttggaattatgtcattaaaacacattaagccaagcatgctggctcacgcctgtaatcccagcactttgggaggccgaggcaggtgaatcacttgaggtcaggagtttgagaccagcctggccaacatggtgaaaccccggtctctactaaaaatagaaaaaaaatcagccgggcgtggtggcaggcacctgtaatcccagttacttgggaggctgagtcaggagaatcccttgaaccccagaggcagaggttgcagtgagccaacactatgccatcgcactcgaatcgagcctgggcaacaagaatgaaacttcgtctcaaaaaagaaaaacacacacgcacattaagagaaattatgtttgtcgttttgtttattctctaatttgattaaattgaacagaataataagtcacgtatggcaataccaaatattatgctaaaaataaaacactgaaagctgaaaaattcaatcacagattattggtttatatgacatcaggcttcaggctgataggagacgtccaaatgataggcttattttgttccataagtattgggcacggttcttagtataacaaagaaataaccgtggattgagaaattgttttcctcaccttcattacttaatagtagaattcccttcaatgtgccacttaatattccttgatgtcagagccttccatttgagcagctgaaattattgacacccctctcattcttcaaggatgtgttgtagggactgctgagtttctgtagaggtttaagctttgtgggaaatgatgttgagtatgacaatgttatcagcaacattgtcaacttcatggttgcctattgacttagggaaaagtggagaaaaatatgacaattgctgagtgcttagttgcagtagctttttaattttaattttcaagcatctgtgtataagcaaaagaatatacacagtgccacgtatcatacccattgacaagtttatcagattttaattataataaatattttaattaaaatgttttttaaaattattaattttaatgaacatcaaatttctctcttgtgatgtgataagggcagtgatagaactgacatttgaacgttcaatacacaattcggccaccattcaataggcttggattgtgcccatggttctgttctgtactaaagacacaaagatgaacaaataaaaactctgcccttgaagccatacagtcaaaatacagtgtccttaatctggggtccatgaaccatgataggaaaaaaattacatctttattttcactaacctgtaactgaaaatttgcatttctttccctttatgaagataagcaacacagaacggtattagcaatatctgtgaatttattaccaatatttttatatcaaatcctagttgttttggatatcttgaaaaatcatatgttaatatataccagtggttagtatactaatcactacttttaatttgtattaattattatgcttataactaatgtattaatagcatataatagtattatattcagtattttacaattgcaatataattaatttcctttgttttttatatgcttttagttttcattttgcacatttgaaaacagtctgggaagtgttccatatgcttcaccagatgccaaagggatccatagcacaaaaatagttaaggaccccatatctagaagagacacaggcaagtacatataataccatggtacagaaaaataacagaggcttgtaccatatgctgtgaaattgggcataactctctcagtccaaaggactgaagaggaaatttttgatttggccttgaagcacacgtgattgtttctctagtggtaacatgtgagagagggcattctaaaaaagagaaaagtaggtgcaaagtcgaagtcacccggtgagagcttgcagggtcagggaacaaagagcagtgtactgtggcaatgtaaacaaacaaagaaacaaacaaaaaaaccttttttttttttaaaccattgttgggcatcctattctgttttcatttgtcaatgtgcaagattgcatttgccaagcagtttttattaatcattagtgagtagaaactattctctggctttttattttaactgactatatttcatatagacaacaggcaagaaacatcaaagaagagatcaaagctctgcattagcgttttaaatctcattatttcaaacaacatctacctgtaaggggaaaaaaaaccgtaaatctttttcacctccccacttcgtcgttgttttcagacaacgatcagtcacttgtctggcctgtgggccataattggctacctgtaaatctcaagagactgaaccatgtaactggaataattttttttttttagcactacactacacggctgttattcagttataatggtcaaggaagctttagatgctgtacttaggctttctaaatgtgtgctttatttggctttctgggagaaatgtcaatgtgaatttccagattataatgaagttcatccagaaaaacaactatgatttaaagaagcagaagaaacaaaccggactgaaaaaatacactaatagactaagatagtgttttcaaactgttctagattaagacaattttgcttgcattctttgttgagcaagaaggttcacatcttaacttttccaataatcctctttaagaccgttattattggccttgatttcaaacagaaaccagcagggacctgaatggacactactagttaaccagtctaaagccttatgttaaagctaaacagttatctctaattttcaaaacaatagcatgagtatatattaaaaagtggttgatctagggaacttaatattccaggatgaactatactaaatgaaaatatgtaacacattaaaatgtggtcaaacaagccatctatagctgatagtacaaattgcatatatatctactttattaaaattttaactggccaataaaattgatactataattctaaatataatttttatttaagattacaagttttaaaattgaacagacttaggtttaaatcacttctctctcttcttctttttttttttttttccgaaacggagtttcactcttgttgcccaggctggagtgcaacggcgcgatctcggctcactgcaacctccacctcccaggttcaagcaattctcctgcctcagcctcatgagtagttggccctccaccatgcctggataattttttgtatttgtagtagagacgaggtttcaccatgttggccaggctggtctcaaactcctgacctcaggtaatccgccctcctgggcctcacaaagggctgggattacaggggtgagccaccgcggccagccaaaatcacttcttaaatgtgttattctgggcccagcacggtggatcatgcctgtaatcccagcactttggcaggctgaggcggtccgatcacctgagatcaggagtttgagccagcctggccaacatagtgaaaccccgtctgtactaaaaatacaaaaattagccggcctggtggcacatgcctttaatcccagctactcgggggtgctgaggcaaaagaatcccttgaaaccgagaggcagaggttacagtgagccaagatcatgccactgcactacagcctaggtgacaggtgacagagggatacttcgtctcaaaaaacagaagacaaacaacagcaacagaaaatgtattattttgtattagcttagctcagcatgtttgcttgtatgtaaagtagaactgaaaaaaaaacctaataaaattaaaatagggattaaatgcactaaaatttgttatttgttctacgtatttcaaaaatggtagtcattctaattatttattttagttaatggaaacattagttttattgttagtaaaacaatatattgttgatacaatatctagcataattttgcctcttaatgaatcaatcagcttgtcctttttattcatattttccttaattataaaccaattttttaaaagtcataatctatcagtagaaatggtactttattaaattcggagaatagtatcatttaaggaaaaatattcctagataaaaaaatatacagtactatgaaattcacatgcatttaaagtcattattaatttataaagaatctggaattataacctgaactaaataattctatttttttgctgaatgaatgaataaataaatgaatctttaggaacttgactgtcctccactaaagttaatgactccttcaacatattacacattctgttgctttgttctcatttctattataaatgcaagtttgcttttttgcatatggaatcaccatctataaattcatagtcaatatggggttttaaataatcattaccatggaaattatacttaagtattagttctgttggttggagattatgaatttctaaatttaaaaaaatgctgatttaaatttattatttccagtgccctatcctatttttttttcatatctgctactgccttcctaataaacttgtttagaaatatatcttgacagcaaatggtattttattcctaccctcttggcatgtattatacacaaactttgttttttgttgttgttgctgttttttttgtgtgtgttgggggggggggggggacagagcttcgctcttgttgccgaggctggagtgcaatgatgccatctcggctcactgcaacctccgcctcctgagttaaagagattcttctgcctcagcctcccgagtagctgggattacaggcatccgccaccacagccagctaatttttgtatttttagtagagacggggtttcaccatgttggccaggctggtcttgaactcctgacctcaggtgatccgcccacctctgcctccgaaagtgctgggattacaggcgttgagtcactgcacccggccttaaacttcttttcgaaagctttctcttttatacgtattgagttaattcctgtttgcgctgtgacatctacctgactaccacaaaaccttacagccacttgcttctgtaaatggaaaactgccctagcatgacaggatgtgggctgaagacataaccatatcgaaaacagcaagctttttggaaatctgtgtttggccctcaatttcatggcctcaagtaacttgataattttctatttctaatgcctgtcagccacaacaggatctgataaccaactaaaatctctgttggaagtgaataggggaaaataggtgaaatcacatttgatgttgtaagggaagcttattgaagacagtggatgtgttcaaaacattatgaggcaaataatgaggaggaaaaaatatgaggaaatagatcaccaggaagccctgtgaatgtttatgttttggctttacatgattactagtaattaaattagtgaaaaatattttatggaatattcaatatgcccttaatgtacaatttgctgagcaataagaatataagactacaaacttcctcttattggaatatacattttattttttattttgttgtacttcaatagctttagggtttcaagtggtttttgcttacgtgtatgaattgtataatggtgaagtccgggattttattgagccgtcacccgagtagtgtacgttgtacccaatatgtagttttttatccctcattcccaccccctccacttctgagtctctgaagtcccttatatcactctgtatgcctttgcatactcataagttagttcccattataagtgagaacacacagtatttgattttccatttctgagttacttcacttagaataataacctccagttccatccaagttgctgcagaagacgttatttcattgtttatatggctgagtagtattctatggtgtgtgtgtgtgtgtgtgtgtgtgtgtggtgtgtgtatctcacattttctttatccactctaaggtggattctatatctttgcgattgtgaattgtgctgcaataaacatatgtatgcaggtgcctttttcatatagtgacttatttttattttggtagatatgcagtattaggattcgtggattgaatggtatacctacttctagttctttgagaaatctccatactgttttccagagaggtattaatttacacttccaccagcagtatataagtgttctctttttatcttgtccatgccaacgtttattgttttttgactttttaataatggccattctggctaagataaggaagtatctcattgtggttttaatttgcattcccctgatgattagtgatgttaagtattttttcatgtatttgttgatcatttgtatatcttcttttgagaaatgtatattcttgtcgtttccaagctttttaaagagattgttttcttcttgctgatttgcttgagttctttgtaggttgtagatattggtcagttgtcagatgcagtttgcaaatatttttttccattctgtcggttttctgtttacgttgatggttatttcttttgctgtgcagaagctttttagtttacttagatcccatttgtttatttttatttttgttgcatttgcttttgaggtcttggtcataaattctttacctaggccaatgtccaggagagtttttcctaggttttctttgaggagttttatggtttcaggtcttagacttaagtctttaatcctccttgagctaatttttgtatatggtaggagatagggatccagtttcattcttccacatgtggttgtcccattttcccagcaccatttattgaataggctgtcctttgcccaatttatgtttttgtatgctttgttgaaggtaaattggttttaagtatttggcttcacttctggcttctctattctattccaatggtctatgtaggaatagacgttttaaaatgttgcaattggaactatggataaacctttaagataataatttttagccactgttcattttaactgggggagaatgggaaaaaagtttaatcactttaactaaatcagttactttgtttacatatatttagctctgataattacaaggagattcacttttgagtttgaaaagtagattctaatgcctaatgagagttttcacattgtctttgagaataaacactattttaggttattactgatatttcagtttgtgaactaataattcagcttgtgaattttacccaattttataaattcacttttcttacttgggcgtctgtgtttgaattaagaatggttaaatgtttctttcatacgcgtccgtgtgaagagaccaccaaacaggctttgtgtgagccataaagctgtttatttcacctgggtgcaggtgggctgagtccgaaaagagagtcagcgaagggagataggggtggggccgttttataggatttgggtagataaaggaaaaaggggggttgttctctggcaggcaggagtgggggtcacaaggtactcagtgggggagcttttgagccaggatgagccaggagaaggaatttcacaagacaatgtcatcagttaaggcaggaacaggccattttcacttcttttgtggtggaatgtcatcagttaaggcaggaaccggcaatctggatgtgtacgtgcagatcacaggggatatgatggcttagcttgggctcagaggcctgacagtttctacatgatagtctctttattcaaaagaaacacactacattattattttaaaacgttattaacatatttttctgtgctagaaaattttaagaaacaaacatttaagtgggctaactcatttagaatttgtaaaatatgacaaaactctaggagaaagtttacctgtgaaaggagtctgttatgtaaatcaatagtgtaattatgattcaataaattatataaattcctaatgagcactatcaatttttcttttgctaaaatctactgatattctacttttaaattactctcacttttagtgttcccctgaggacttatcagtttggaacacttaaatttgagttatcgttctgttcttaggaaaaatatatttaaagaaataatgatttattatgctagatttatcattatttttatttgggattgcttttaatgtgcatgagttacaaagacataactgtgagatcccattttctataatttttttagtgattccatacatttctgagtttacattttttaaaaattatagctcaaaaaatgcaagacataagtaagtatgcttttctaatgggtcatttcagtcgcgtccgtgtgaagagaccaccaaacaggctttgtgtgagcaataaagctttttaatcacctgggtgcaggcgggctgagtccgaaaagagagtcagggaagggagataggggtggggccgttttataagctttcggtaggtaaaggaaaattacaaagaggggttgttctctggtgggcaggagtgggggtcacaaggtgctcagtgggggagctttttgagccaggatgagccaggagaaggaatttcacaaggtaatgtcatcagttaaggcaggaacaggccatttccacttcttttgtggtggaatgtcatcagttaaggcaggaacaggccattttcacttcttttgtgattcttcagttacttcaggccatctgggcgtatacatgcaggtcacaggggatatgatggcttagcttgggctcagaggcctgacaggtcagttatggaaacacatcaaagtactctagaaccaaaagttaatttttgaaagaaattaacttaatgtacagattttataggaattctggacgtatttaatatcgtgatgctagaagaatgtcttaccaattaatattactggatttcttgttgtgtatcaagttgtaacagataccttaatcacctaccagataggctcattcctgtgtccattccaatagaactctgattttgctcagatctccatcctcacaatttcacagtagtcttcagtaaagaaatgagactaccccttgtcacagaaaatgaatcatactttaattcgcttatatgcttccataccacttgccatttacgggtttaagtatgtgcatgagatgcaacctgaaccaattaaacatcaagtaagtttttcttgccaatgaaaagcgttcacttaacaactaaatgcttgagcatttatatgtagatatatatgtacatatatacgatgtaaaatgtagaatgcccactgattcatttataatttgatatgtattagtatgtatttaataagctcttataagactgaatggactctggatatgaaataatataccaagtatggtaacacatggtaacacatggacaaattgtagtggaatcaataaagcattcagagaaatacatcattattatttattctcccactttaggaagatttcaatcctagcattaaatgtaacactgtcttttttaaaataaaacctccatttctaagaagttatttgatgagaaaatatttgagaggttatctgatgagaaaatttgaagaaaaaaattttaactgtacaaccagttaattagaactttgtcaaataacattgcctttaattcccagaaatccaatacattatgctcagtgaactgtaacacctgagtttttaaagtggaatacttaaaaaaaaaaaaaaacaaaaaaaaccagccttctggggtaatatctcctctttggaagtttctttttttccaaaattatacttaaaggacgattcttttaatgaataaattttagagttatctcaaggaataaatagaggaaatattattttatttcaaagagaagaatgtctattgtggcaaacaacaaacctgaaataaataaaacgtgacagtctatgaagtccgtgagcctaaagaacaatggttattttactgtcttagaaaagtttaggaagtttggatttgaattcaaactttaatttgaacttataacgtcaacttgaaatcatttggaataaacattgaaaaccttctttgaaagttttatcaaaggagaaagaatttgaataccaagaggatggaaaggttaacttctgttatctgaaatatcttcaattgccttgagccagtttaaaaataaacaagcttactgatatagagggaaacaagtctaccttgtgaatataatttaaaaaagagaaaaaatgtcatttaccatattatttacttcctcattttagaaaagggaataaacatttattaattatgcactatcaggcactacgcattcaacacacactatcacattagttcttcccaaaagccatttgaagtagtttttctttctttttttttcttcttttcttttctttttttgagagatggagtcttgctctgttgcccaggctggagtgcagtggcacgatctctgcccgctgcaacctccgcctccctggttcaagcgattctcctgccttagcttcccaagtagctgggactacaggcatgtgccaccacgcccagctaatttctgtattttttagtagagacggggtttcactatacgttggccaggctggtctcgaactcctgacctcaggtgatccgcgtgcctcggcctcccaaagtgctgagattatgggcgtgagccaccgcacctggcctgaagtagtttctcttatgcccattcatcaatatagataatagggttcagagagatttttcagtaatttacacaagattttacagctcctaggtggcagaatctagacttaaatttagatctgatccaaaaactgtattttcctagctttagtaggacattaacaatacaagtgcctctttaatatgcttaggaatgcatttttatttatatgtaaaaccaaataaacaaataaacgctgcgattgccaacaaagtatctttaatgtaagaatttcaaatgctgtgcaaaattatcctcactaactgctcttctggtcccacacttgtcacatggctacagaatatactatatctctctttctcttccagcagcttcctagtggccacacagggaccatcctatccataggttatagttgctttttaaaatctaggcatttcctaggagctgatgagattttagaagaggtgatattaacatgaaaaaattggtaggggtagatttctgagatattctatccaaattcaggagttttacaattataatttagttaaatattgtacttgatacacatataattccattaatacactctgagttaattgattttcatttattactcatggttttcattttttgttttttgttttttgagacggagttttgctcttgtcacccaggctagagggcaactgtgcaatcttggctcactgcaatctccgcctcctgggttcaagcgattctcctgcctcagcttcccgagtatctgggatgacaggcatgcgccaccatccctgactaattttatattagtagtacagatggggtttcgccattttggtcaggctggtctcgaactcctggcctcaggtgatccacctgcctctgcctcccaaagtgctgggattacaagcgtgagccaccgtgcccggcttcatcgtttccatctttaacaaagaaatacatgatatttaaagaaattttaaaagtataattttaaaacagagggaaagccacccacagctaaaacatcctttctctaaacagtttattttttccttaataaagttagatattttttggtgtctaactttgcattgtaaaacttaatcattacttacattgctccataatattctgtcatatggttttgctgtagaactgatactgagttggtgtgccccttgtaagaatagtccagtcattttaaaccagcatctgtttggattgggccagcatctcttccagtgtccttgagtcaacaatgccttaatggtttctacatatatttttaaatattacctatagatagttcattctttatcttcttatgttgcgtgtcagagctattacgttagagctattatgtaattttggcttttttatatatcattgcaattaacactcttgtccattaatctgtttgggttttttttgttctctagttgacatcttatgacaaatcaataggtgtgtaaactatgtcgatttttcttggctgtaaaaaacagtaaagaatgcttacagtacacgttgtctttatgaaaggaagttccatttgaagaaataattaaaaaacaatctgttttgcctttaatgggcaagatgaagagttaatgccactatatactaaatatcttaatctcgacatgaaatgagaactattctagagatatgtttctagatagatatggaacaaccacaagttcatacaaaatttgttaattttaagtcatattttggacttttattaactcatatggagtgacgaacaaatccttaattaatagcagacatatcatcatctctggatgcttatctatcagagatcagcaagaaaacaaacacacggcatgctaaaatgggtaaactatgagaggcaataagaaacaatattcaaagttgtgggtagggttaagggaaactaatgaatactgtgatgcaggtggcccctggctctggggacaatagaaagacataacccaccactaggcctaaaaaaggtaaaatgtgagggagcaattactagatcctggaaatggaggagctgaggagagaccgcccaacaagagctgtgacctttgaaaaagaaatacagccacttacaacctgagctcttgcaggtgtaaaaagtagaggtttctctccaaagaaactttcctacccatctaaatgggaataaatagtaacgtctcctagaagcaaaatttattaaacgacctgtgctaacattcttaaatatctactagccgtaataaagaaatcaatgtactttatgttcttagttcccacaatttagcctaaatatttgccctggcatgcttatactggtccaagcacgcattaggtcatagcctgttcctcttccttatttgaaggtgtttttacctttctcagcaagtaacttgtggaaacaagttacttcctccttcctttgttctcctctgcctttgtctcttttgaaaagttctaagttgctagccaatcgggacaaatacagaatgtgtggtcctgttccagccaatggaaaccggacacagcagtagagtaaacatgtcaggttataaatgaccctgtctcctttgttcggtgtactctcgtggcaaaactgctggcgagtgtaccctttctgcaaaaagtaaaaatgaccttgctgagagagttaaatttatgttcgagtgctgtttctttgcagcaccagggaacaagcattctgtttctaaataaacattgtttacatataacacagggaaggagcagtaaagaggatacagcctccacacacctttgaaaagcactcaagttataagtctttagtgccgtgctacttaagagaagggcttgggtttgccctaggttatggttatgctaagctcctcacaatttttataccacatccaatgacagcagacccattcaagcagaattggtttacaccatgagaaactataattcaaagaaagttagcaacttgctcctaggcatacccatattaaccaatattattcagtatatttatatacagcgcagagaacaacaattttaatggcattgtcagtattctttgatagataagcaccagttttgtgatatttaaaaagctattataggtgttgaggcttcgttttctcttccgctaaactgggatgaatctttctgaacagaacaaatacatatattctgtcctatctgggaaagattcaattatgtgttgcagtccaaatatgctgtattatatttacaggtaaaatcatactagcagaccagagtaaataactaggtaagttcctcttagtgacaataaaaagttatattgctcagatagtgctaatagaactttctgcaatagaaatgttctgtatctatcatgaccaatatagtagccaatagccatatgtgactattgagcccttaaaatgttactggtggggctgggcatggtggctcacacctgtaatcccagcactttgggaggctgaggggatgaattacctgaggtcaggagtttgagaccagcctggccagcatgatgaaaccccgtctctactaaaaatacaaaaattagccgggcgtggtggccagtgcctgtaatctcagctgcttgggaggctgaggcaggagaattgcttgagcctgggaggcagaggttgcagtgagcccagatcacaccactgccctccaggctgggcgacagagtgagtgagactctgtctcaaaaaaaaaaaaaaaaaaaaaagagtctcatgtataaatactgttttggacacacatcgttagaagacagtaaaggtgacactgtaaaaattttaaatcattaataactaattaccaccccaatgtaaatttcactgatcactgtcagtattaattctacagtaacatctgtatcaacaaatttccatatccctttcactggtattagggaggagatatcaaaagatggtaaacccagagcataaacttgtagatgtttggtaatgaaatgggactggacctatttgagattgtttcacaattttaaatcagggattggttatatagagctttctttcttgtattttttttctgcttctatgtggaaccatctagaatgcttgtgttattgctttaaggaaagtttttaaagggattcttaaaaaatacagtattttcctagcatatctctgaggtgataaaagtctaagaatcatagtttatgtgttttattcagatccagctcattctctcaactgttaaataagattcttgagaacaggtattattttttacattctggaggatccttatagcacatagaactatactgagaccaaactcgataatttcttataattttgattctgctggtaaaacacaaacttgatattgaaaatttgaatattctggacattataatttgcttatgaatcattctgtttgatattcccagataccctttgctaaggcagctcagaagggaaatatttgttcttgcagtttgtgtggttacgtggtttgttgtaaactttccctttgacctaaagaaatattgtccctttggccaggtgcggtggctcgcgcctataatcccagcactttgggaggctgaggcgagtaaatcgcttgaggccaggagttcgagaccagcctggcccacatggtgaaaccccatctctactaaaaatacaaacgattagccaggtgtggtggtgcatgcttgtaatcccagctacttgggaggctgaggcaggagaatctttgaatctgggaggcagaggttgcagtgagccaagatggtgccattgcactccagcctgggtgacaagagcaaaactctgtctcaaaaaaataaaaaaaaaaaaagtcgtctccaaaatatagcatggcttcaaacagatcgcattatctctctgaaacattttaacttatagatttaaaaatatatcttacagaaacattatttagaaacacaactttagtttacctacctctataaaatctccagagccagagtaaagattaaaatatgcattcacaaagagctttttaaatcatctctttattttacatctcccaaaaattctggaagaaggccgggcgcggtggctcacgccagtaatcccagcactttgggaggccaaggtgggtggatcacgaggtcaggagatcgagaccatcctggctaacatggtgaaaccccgtctctactaaaaatacaaaaagttagccgggcgtggtggcaggcgcctgtagacccagctactctggaggctgaggcaggagaatggcgtgagcccaagaggcggaggttgcagtgagccgagatcgcaccactgcactccagcctgggtgacagagcgagactccatctcaaaaaaaaaaaaaaaaaaaaaaaaaaaattctggaagaagtagtgtttgatttagcactcttaagggacaccatacatttgatgttgttaaaatagcttacaggtttatattagatttctattatctatcctgtcttcatttttggatatcatgtaaatatgttagataaataaattgagattgatttctaacaatttgtatgcattttgagatggcttagaaaacattcaatgcagaagttgatactgtgactcataccaagcatgctcctttgaatataagaagacaaaacttctgaaatgaggcaaatttaaaatatgacaggtttatattctggaggtagtgctaatagcccccaaagctactgatacatgagtttgtacactacagaaaagagaattaaaaagaaagtttgcacttcattgcagttccactcttgattattaatataaatcgaatgtaaattagtgaacttcctgtaaacacaacatgagcaatgactaatattgatagtctactcttaggttcccttgaaattgttctgcttgtctgataaaaccataacaagggacataaaaagattgttttaatatgttgagtgaattgtacatgaaaaattacattcccataaaaggctgatctatgaatgctaacatttatgttgttcgctatttctgtgtacttataccacccgtgtgagtgttgcttgatttggcagaagtaatggaattttaaaaagcagttgcatgagcaaatatatctattttccatatgtacatatttgcaatttagcaagtcatttgcttttgtttaaatattcaaaacgttgtcatatgtgtgttgtacacattaagattttatgtattttaaaaattatatatgtgtattgatatatttgtatgcacacagagcaaagcttgaaatagcaaaaggtaattacatgcatattgtatatactactttgtattaaaaatgtagtttattgatctttaaaaccaaatttgtttttgtaataaagagtaataaaaaattagattatgattttttcctttcaaatatgtttagaatttaaaaatcttggctacccctttaacctaaaatctgtcttacttacctcaaaatgcccttgatcccaactacatgaaatttcttgctctttcttttttttctttttttttttttttgagatggagtcttgctctgtcgccctgcctggagtgcaatggcacaatctcagctcactgcaacttccacctcccaggttcaagcgattctccctcctcagcctcccgagtagctgggattactggtgactgccacgatgcccagctaattttttgtatttttaggagagatggggtttcatcatgttggccaggctggtcttgaactcctgacctcaggtgatccacctgccatggactcccaaagtgctgggattacaggcgtgagccaccgcgcccggccttcttgctctttcttaaatatattatgtaattttatatagcacatgcatatttctgtgtctgggacacccttcctccctgtatctactccttgctatttcttctagcctaatttagatccctctttctatgtttctctggctcttttttcttaagatttgtcaagtcatgctgaaactattgccttgtctttctcaaaagactgtaagttcattgatggcagaacttaagtgtatattagtatctcccagaactcactcagggcctggcatagagtagcataaaagtcagtgttgttgaatgaatgaagaaatgaatagaatgataactgctttctacaggtgattgtgtgtaaacaaaaagtcatatgattaatccttctatgagcaaaagttggctaagattacaattaaatctgaatgtgaagattgtactgcagaaaaaaaaaacacacattttcaatagttatgtcacaaaagcaacccatcatgatacaagtagaatctgcgaacatttcttttaaggtgcgtataaactcatggcaaatttatgttgcattagtctttttgatgttctgaactttcataaaaaatcaacatagtatttaaaatctattgtaaaatatattgaagtttcattgattttattaaaatattaattcctttattttatatctatatataatataatcaaatctgaaaactcatcaagattatggcctagttgattacgtcttagttattatttgtacttttccatagccaacatgcaataaaagtttggttctagataattttttcctgttttacaccgtttcaatcaaaacatgttacaattgagtaaaacaatctgaaccagccttttataatacatgaattccaagattgtactaatttgtcagtttttgcttactgtctttcacaatgatttggagacataataaaatgtgcaaccaaattagtgaaaataaagaagtatatatataattgactagagccaaatatgtatgcagatttaaggcctgatgttttagttcactcattcaaattttaattaaaaacagtacataaaaggtgctagttgctggagtatgatgagaaaacaaaacagtaacaagacaaaaactgaaaacatgtttcctatccttgtgaaacttactgtcaatggggaagacgtacactcagtcagagaaatgttaatatttacaacgtaaagtaatatttacattatctgtattcagaaagagaatatcaaggaagcctattctgttggagtaaagagcttatgcaaagctcctattgtgggaaggaacagaaaggccagggtaactatatctaagaagaaaattacaggctgggcacagtggctcacgcctgtaatcccaacactttgggaggccgaggcgggtggatcacctgaggtcaggagttcgagaccagcctatccaacatagtgaaacttcatctctgctttaaatacaaaaaattagccggacgtggtggcgggcacctataatcctagctacttgggaggctgaggctggagaatcgcttgaacccaggaggtggaggttgcagtgagctgagatcgtgacactgcactccagcctgggcgacagagcaagactccatctcaaaaataaataaataaaataaaataaataaataaaaaagaaaattacggtgctacaagacgaggaggaactacacagaagcctcttcattcaagaaatgaaagctcctgagttcggatatctatcttaaaagcagtagtatgctattgaagaattgtaagcaaagggtgtcttgatcacattcatctgtcaaatagctctttattggtgaggttatgagaatgtattgaaagtaatgtaatcaaagcaaaagaggtcagttgcttggattaagggtgttggctaagaagataaataattgattcgtatgttattctgggacccctagaagccaaagaaaacggaaaataagaccaattataaaattcttattttcagagacaagaaatgccttcaggaaaagggaatttttttgtataattgtctactaaaagaaaatgttcacttatgactttagtgtatatagaccaatttatttagctttaaagtgaaattaatttcaggatatttggtagtaagttttagcaaaacctaaagaaaatagtaaagcacacatttctgttattgatacataatgatcagatatatttccatgataaatgtgatattataaagcacaacttttaaaaaacatttttctagagattatgccttaatttcagcctgtggaacatttctttaggagatattcatggctgctctgtgtccaactacatttgggagtcacctcatactgaatccttttatatactgggtcacttgcaaaggcttaattgagcatttgactgtcatatgccacagaatggatcggacactataaataaaacacaaaagagagtttgtcttttctgggcttcatcttcttaaaaaaatcagctattagacaagcatatgtaagtagtcaagaattatgataaattttctaaataaaaataagtgcatgagagagcgtaagagtatttatttaattcaggtttgggatcaggaaggtctcactgtggaatatttatctaaaatgtaaagggtgaaccaagaaaacagtgatgtggaagagcattagaaaatctggaagaaacacatgtagctgaagcaaagattatgcttattttgaagaaccttttagctgcagtaaataaaagacaccaaattacctccaattctgtaaagcagccttcatgactattcttcactttgttcacaatttattatctccagcccgtactaaatagataacatcatctcctacttcactgggggcttgaagggagaaaacagtgaactaaacttttacaagacattatttgtccagctggaaataaaaagtagaaaaaacatagaactttctatgtatagaggttataaagaccttaattgctttttaatttgtttagttcatgcatcctttgtcagtctgataaaagctgtgggactcctcagaaaaatacacagtgaatatcctttacatacaaccttttacataaaaatccagcagttcaaatgctcctgcaatccattcataagccattcataatccattcctaaaccagcttttggttaagtatccctgctttcaagtatcttgataaaatagtaaaaggaccagaagatacataaatataaatagaaaagtaaatagaagtgtgtgtctgctttactagaattttgaaatatcatgtttaaactataaattttaaatttagtttatggcttaagtacagatcatatattcccataaatgtgagtatatacatttatgtgcaaaccttcgctcacaaactcatatgcttagtgtttgagatttctcagtcctggactgagagttgggaaaaagttatgttttctttaacattctctcatagaaccaaaataataggagaatcagaaaaacataggcctttacattttggcttgagatcagcttctcgccatacctctagtacctcagacaaattacttaacatgtttgtacctatattttatctactttaaaatagaaaagaatacctaacacaaattgttcttatgaggataatatatgaacattgactgaaagatttaagctttttttacttaaaattatcctgttatagatagccttttctcaagaagtacataaaaataataatagtaaagctttgtgaccacaaaaagctacctacagtatatgtatgatgtttaacatatataacttgatatatataatatgacatatgcttgatatatataattagacatatgcttgtctaatagctgatttttttaagaagatgaagcccagaaaagacaaactctcttttgtgttttatttatagtgtccgatccattctgtggcatatgatagtcaaatgctcaattaagcctttgcaagtgacccagtatataaaaggattcagtaagaggtgactcccaaatgtagttggacacagagcagccatgagtatctcctaaagaaatgtatatatataatatcgagttatatataatatatatgttataatatagaatagaatattctataataatatagtatagaatagaataatattctatactatcatttaatatgaaactcacatagactatatttgtagctgtgggtaaatacatgtatgtaattttggtatatatacgtggcttatgagggtttttatggagacatgaatatggtgttaactaaattattataagtccaatgagctttgtgagatggccagtcgaagcaaacaaattccatgtatctccgaagccatttcctctagattgactgaaaaaaaatcaatttcctttaataaacatattttacaagctttgtagctatcacttacttcgtggttaaagtttacatctatggaagattacacagtaactttgtgctcacatgattgagtatcttaggggtttttatagatacatacttaaatatgtcagggaacttcatagttgtatgattggatgtactgggaacttcttgctccttctccttaatttgtgaaatcaagagacagagttactgcaaatttaaacttgagtaagtcctttgctctacttcatttttctcccgagaggcttctttttttttaaacgtccttttgtagaggcaaaatgtaaatattctctgaactctacttctgtatcttaccgtgaagaataataattagctcattaatttcaatttttgtaatatgcttaggtcaacaagattacttctaagggctcctcatcaaatacccctgtgtactttaggttcttttacttttagcaaggctgattcaaagttttttaattcataacttttttaaaaatttttccgagagtcacattgtatctcctttatactgacgtttattatcaggctgtttttttttgagatggtgtctcactatgatgcccaggctggcctggaactcctgggctcaagttattctcccacttcagtcccccaggtagctgggattataggcgtgagacacaattcctgggtttatcattttgtaaagctggagcaatcagttaagaatggagaagcaacagggccgcacggtggctcacgcctgtaatcctaacactttgggaggccgaggctggtggatcatgaggtcaagagatcgagaccatcctggccaacatggtgaaaccccgtctctactaaaaatagaaaaattagctgggtgtggtggtgcgtgcctgtagtcccagctacttgggaggctgaggcaggagaagtgcttaaacctgggaggcagaggttgcagtgagccgagatcgtgacactgcactccagcctgggtgacagagcaagactctgtctcaaaaaaaaaaaaaaaaaaatgaattgagtagcaatagatatcatgagcctcctcatggcgccaatattcgtttgaacccgccaacttcacatttagatatatgtgtctacgttgctggatgggccaggctatttgctcatctctcagttattttactatcctgtttcatctttttccataacactgttacactcacctttttgtgtcacttttaccagagccagtcattaatgaacaagaaatgtctttatttcatttcaaaaaagcaaaatatttctttgaaaattaaacagttaatttccaagccactcattaaagttattttattataagttttaatatcagaattataaaaatatttaatatgtcatctggtaattaatatttattcttttttttgagatggagtctcgctctgtcgcccaggctggagtgcagtggcgcgatgtcggctcactgcaagctccgcctcccgggtttacaccattctcctgcctcagcctcccgagtagctcttagcagcttcttaattaaagaatccatagctctctaatgcacatacgattgtgacatatttattcgttactttaagatcctcccccagtgttgaattctaccaattgcaaggtgcttccatggctttggacaaagtacagaagaattaaataacttcacagccttcatggaattcacagtaaggcagatcccatattaactcaattaaaatatatttagtcaaagccagatgcagtggctcacacctgtgatcccagaactttgggaggcggaggcggatggatcatttgaagtcaggagttcgacaccagcttgatcaacatggtgagacccctgtctctactaaaaatagaaaaattagctgcatgcctgtaatcacaactagtctggaggctgagacaggagaattgcttgaatcctccgggaggtaaaggttgcagtgagctgagatttcaccactgcactccagcctgagtgacagagactccatctcaaaaagcaataaaaataaaataaaatatattgagttgaatactgaaataggggtaactttgggaagctatgggccgcaaagcagagaatgatgcattcagtttgggggagctaagattagtttcgtaaaggaggtgacatcttgaagacatctagaatttcaatagacatagaaaaaattcatcgtaagcagagggactagtgaatataaagaagtcataaagatccaaaaagaactcagaaataatcaagaaggtgagggtagctacatcataattataagagccaactttattgagtacttcctttgtcaccatgtgctaagttctgtattttaatatcctcattgaatgcttgaaataatttctatgaagaaagatctgttttatctttattttactgggaggctgtgaaatatgcctaaggtcacacagctatcacatggcaaaaacaagattcaaacccccacagtttctaattttaaagcctcagcataatgaacacagtattgtactgaacagaatgaatgaatgtgagtagaaaagacatttctgagaacaaagctggaaatgtatcatacaaatcaaataaacatttcttgagaaatccttggggaagagggcaatataacctctcaaacagtagccagaatcatcaacacaaatatgtattttaagttctcacaattggtctcgccatatgaactaaatgctagatatttacttgcttaatgctaccaatgaattttcaaatctttccaaggtgttaataattttattgcttttttataccaagagcaagaatcaaatgttagttgctattgatgtttacattttaaataacaactttaatttagcctacaatatttagcaattacacaggaatcctctgaaagcttttaaccagccccagaagtaaactggctttggatgctaatctcttgagctttcctgactgacaagtttcctccctagaggaggggaattggcctgtctcctaaattttgcatggcctaaagcagtgagtttagaagcacctgtgtttcctggcaacaaacataacatttgtggaaaagtctaattatttaaattcctctgcatttttctaattgaggataaagtgctgcattctaccttcgcattcttattttattccttggccctttaaataaaaaaatacataaaatgatgtggtcagctaaaatatattggacaaacaaaacccccttcctttatctccctctatcgctctctatgtatatatattatatacatatataaaatatatataaacatatatatgaaaacagatatttgtgtgtatatatacactaagagatattatagtttaaatattttttaacatacactttaaaatctaacagcttggattttaatattgggtcagtctttctaaagtgtttaatattttagtttggaagtattaattagcaattcatgaatgagtaattaaaagtgctttagggggcctttcacatcctataataaataccaaaccttttaccacatttcatactataaaatcttggaaccccattatataactatgagttattaatttctgttacctacttttaaaatgggaacatatgttattaacaggtgttgctttgaaatctatattagcaaatgttctaccttataattagtttttgacttatcacaaaaaagtattttattttttttaattacatagtcacatttcaaggttaactttaaaaaattctaaattatctgattttcatgggaaagagatttgatatttgtgccttagcattttggtatttttctctttctgtatagcaaacctttgaatgatagtctgtctgaattcacagtgaagaaaatgatcagaatattgactgtcaacagataatttagaaggttcaatcctatgataatcagggatattttccttatgtaaatgtgttgatttatcaagttcagctatgtcattgattacatctaggcttcaggccttctgtgaactgccagctctactcaattctggcttgtgaatgttatcacatattttagtcaaatcagaggttatattatacacatctgacatttttctctttgtactaataactttttttctttttttgtttttacatcatggcataagatcaacactaaattttaggagtgcatagtaagtattaccatagtgtaatgctatgccaattgttttctaacttaatatttgcaaaactgggttttatggttgtttctatgcgaattgagtgcctctacagaattttatccctgagagtatatgagtggtgagtgataagagatactgaatgtctcagaacatactagcatctgacagcctattggtaagatagtgtaagtaaagaggataaggaaaatctgacttgaaaggagaataaaatctgattggacagtctgtagccaagtttgcatattatggatttacaaaatgaggttgttttgaattcttgattaatgaaacataaactgagttgttttaatattgcgtgccatttgaaataaaatgcattttgtcacaaccctagaaatgggaggttatgtgttgtaaaatattcttgttcccatctagaagacaccatattttatagagaacagtggctgaagcttgttttactaggaacaagtatggtgtaaggaaataacaataattaatactggtggcacttagtgctatagtaaaagtaaatttctaattagaaaataattaccataaaatactgaattatatctttgtaaggcctttagaaattgaatcactaatttaatatataagtaagtcaatattatttttatgagaaaatggacaacttacgaagttgttgttatgttttcaggccatattccatttttcaccaaacaagttatttccctgatacactcacttaaatcatcagtaatacatataggtttaaaaatgttttgtacaattctgaaagcctatcttagtttaatgaaacataataccataaagcttccctttcctccaacatttgagctacaataaaacaaccttgtacaactgataacaattaactcaccacccccaccccattgcagtcattagaattcattactaaaagctcatttgtttatggtaaaataaagtataagggttttgaaaccaccactgcaaaattaggactgagacagtgaaagagatctaacttaactgactccatcttgcttctaacctccactaatttatagtttatcgtttaaacaaacatcataacagccctttcccaaagcagaccttcttgcctggggactagattgcctctgtaggactaacatcagccacagtattagaaattatggtttaggagtcatgcagctggaggcaacaagattctgacccccaccaaactgctcctaagatcagtgcttgagataatttgcagaccctgcacttgatggatcagctggcactacccatatcaataaactggctcatctgatcttgtggcctccacccaggaactgactcagcgcaagaagacagctccaactccctgtgatttcatctctgaccagtcagcactcctggctcactggcttcccccgacccaccaagttatccttaaaaactctgttccccgaatgcctggggagaccgatttgctgatttgagtaataacaaaactccagtgtcccacacagccagctctgcatgaattactctttcttcattgcaattcccctgtcttgctgagtcagctctgtctaggcagtgggcaaggtgaaccccttgggtggttacaaatttgggggctcacccaggattgcccctgtggctacctgcctgttgtttggtggccccctttcagtgatggatccagaaggcagcccaagtggctgcctaattctcttggactgggggctgactctgttactctgtctactggtggggtattccaacccaatgtgcgtggacttaattgcaatggaaaaatagtcatggggagatgtcccttaactgtagccctattacagggtatctgtagcctcatggtggggtgtctatctgtagctccgttttggggtgtctggattggtgagtatcctaggtgctgccaatgcctgcttcattctcctgactggttctgtagccctatggtggggtgtctgtagccccattgtggggtgtctgtagatccagcatggggtgtctctgtctgttactccattgtggggtgtctgttcagctcctgggaggtctcagttcgctctttctaactagtaggaagactactggtttgggagacttctcttcaatcaggaagattttgaggaggtttctcatacagaaaataggaggatagtttggaagggatactcttggacttcttggttagggatctgatttggaaggccttctgtccctcttgtctttgcatgtgtttaaatatgtgaaagggatctcagaaggggttgctgatagaagtccagcatgcctaactcagagaaccctccttatttgtctggtcacattcagtgagctctaaagaaggctcaacagtcctgtctctcagggtgactatctgctctttcccttgcccagagacctcattgtgaattaccgttcagaggtcatccgtccccacctggtgtggatcaaagacaacagggaccaagatgaaaaattttgagctttgccaggctgatattgggtgcggaaagaggtgactaatgtctgttttgttatgtgtattttgctgggttggaaaatgttaattcagttccccatgcagcccgttgggcagaatcttgcaaattaagaatcttgtttatggttccataaaatggtaaagggtgattttatcttgtaaagtggcttaaaccccacagctatagcacaagcaagcagggtcgtaagacgccactccgttcttctggaagctgcagagaaagggaacccagaaacctggcatcccagcaataagggtaagaaattcttatcagtcaagtttctggtctctctctctctctctctctttctctgcattgttaaatagtaaactatttgtctcctctgcaagggtttggttaatagaaagaaggatttgtgagactaatcttagcacatctgatgtagtttgtgctaagaatttgtctttctgtgttatgtaatggagagagggatatcacgtgatagaacgtgggttaggacacccataagtctgcttttcaagtcagcttgggaggctggtcagctacaaactttgctacaggtccctgaaaccaatactctatgaaatttctctgtcttgttttgtgtccttaagagcttaaccttgtgaccatgtggggatactttcttttggtttctaccatccagaggacaggaattttggggttcatgtcatagttactcctaagatttttcttgagcagttaaaagccttgcaagcctgaaactggcttctctaggctccttctgggaaaagcagtagaaatttctcaacgctgtatatagctcagtagctaaggctttgtcttttgacagtggtggcctgggttcaattgttggcttctggaatgattcctttctgatttgttatttgtgtagctttgccatttattaagtttcttttctgatttcctctcttgaattttcctttctctggactaccttgtggagattctaaatcttgtaaaaagaaacttcttactatgtctttgcagcacctaggaggtttcctttggtaaagttcagaagctaaaaatattgtccacttggcatggctaaaattaggtaataagagatctaaaagaatttcttttttaaagagcactatggttaaaagtcagcttaattaagagtggataaacaagctatagatatatttaaaaggcctttatgtttttctcttcttggaacttgtttttttggaaaaagttttttcttctcagccgactgaattatttttctccatttttttctcttttttaatttttttgtcttgccactcttaacgcacacgtgagtccctaagataacttctggtagcctgggactcattgggaaaaacagaggaggcaccacagaacccgttttagggaaaaaaaaaaaaaactgttttccacatgaaaccccaggaattaaaaacagatggatccctctcaaaatcaaagactctgctctgtttttcattgtgttatctgatggttttgagttttggggatatcagaaattacttcacattatgagggagctttagtgtgtaataactagataggaaatatactttaagggatggctaatggtagttatacagggatacttgactctttgcacacttggatccagagaagcatgcttttggtcacccggaagataaggaaacattcctcaccctccactgggagatcagactcccatgaaggacgggctgattacaaaatgggctgattgactttgggttgccttgcaatgaaatgcagggtatggccgggtgccgtggctcgtgcttgtaatccaagcactttgggaggctgcactttgggaggccgaggagggcggatcacttgaggtcagcagtttgagaccagcctggccaacatggtgaaaccccgtctctaagaaaaatacaaaaattagccaggcgtggtggcacatgcctgtaatcccagctacttgagaggctaaggcaggagaatcccttgaacccaggaggcggaggttgcagtgagctgagatagcaccactgcactccagcctgggtgacagagcgagactccgtcttaaaaagaaagaaagaaacaaaaataagaaaagaaatgtagggtagaagcactgtactgtcttctcccgtagtatttctctccttttgggttgcagtataaaatggtgcccttaatttgggagttctgtctttgccttcagctgtgattaagccttagaaatgcatactttcctggccctgttcctccaaaggctccaccctgaagccagtaatctgattaagaaactggcaaataaaaagtcttatcagtgccaaatcttctgtctgtatttacatgtgtttttgtgtgtgtgtgtgtgtgtgtgtgtgtgtgtgtgatgtttataaaagagctctgattaattggcttggaaaataagtgcttaaataaaaaaatattttgtcagaaaaatagaaactttgatgactttttgttcacatgactttagtaatcttttggcaataaagacaattttaaagattattgttaaagtaaaatatcttgaaaatgtagacatttggtctaaattaaggtcagctatcagatttgctaaattctttaaggtcaaactgtttccttgactttggaaaattgttcaatttatttactttggagcattatattatagatgaggcctggggacacgtggagagctatgcccctagctatgctgaaaagagtcagaccttatcttcacttctgtctgatgtcctaggctccatccctagcatataattaaaatagcttttttatcaggtttttcactaaaaatcaaagttgctaagagttaacattgtaacatgaaatcgaggttactggagaaacagttttacatacaaggtgtgtagggaatgtgtttttggtgaaagataataaggcataggaatatggcttttgttgaagagaatgtaattttgtctagttcagaggttttaaagactgtcttaaactaaaagagtaacggaacgaaactgagggtttaagcaaagtgaaaagggtttatacagggttgatcctgaaaaaaaaaattctgtgggtataaacaagttggctaagatttgaaaaaggttatttagctttttctataggttaaaatattaaagtcatactgtggggccagaatctgggcccatgtgtccaaataacagggtcttcttagaaaattgatctgctgtttaatggaaaattataaagcgttctaaaaagtttatgagaatgtcaccttgtggtcaaactaattaaaactggatagatacataaaattttatttaaaaactagctttagcattaaagatgcactaatgcgaacatgaaatttggttttctcttttgaagacgatttttttgtaacgttaaaagataatgaaagggtttggctttctcctttgggtaaatggcaggggaaaaggggagagagaagagacaaattcagttatcctcatgctgtctttattgggtcttgtttggaaagctaagtctcctctgtcagaataaaggtttttcttttaagattttggagttatcgttttggtcaaatgaatgacttatggtgacctgggattctattttgtgatatccagtgttttaaacctttgatatttggcaaactttccaaaatcaaattataaattatgtctctttctggcctaatcttttagatattaggtcctctaaagtccaaaaatgacatttggcgtattttgcataaaaatcatacaggaaacattgtcaaatatgaaatggtgtttggctttttgggggctatatttgtgtaaatatatgattgacatatgttctgagattatgtaaaactcctataattctaatatgacttagtatatgttatcagtaataattgtaattatgttaaatggctatgtgccacagaggtaacaaatttccttgtcgattgtgtctttaactctggctactctacaatgtttgtgtcgtccacaggcaattgttgtctcatttttgtcctcttaaaagatggttttataggccgggcatggtggctcatgcctgtaatcccagcacgttaggaggccgaggtgggcagatcacctgaggtcgggagttcaagaccagcctgaccaacatggagaaaccccatctctactaaaaatacaaaatcattcctgtaatcccagctactcgggagaccgaggcaggagaatcgcttgaacctaggaggcggaggttgcggtgagccaagatcatgccattgcactccagcctgggcaacaagagagaaactctgtctcaaaaaaaaatggttttaataccagctgtaaaatgtaacaggtggtcttaaatgcaggtttctgattaataactctggagattgtgacgttagaatagaaggaaaactttcaaatagaagagtgaatggtgtttggttttctttggactgtatttgtataaatatgttattagtgtgtgttccaaaaattatgggaaacttctataattctgatatgatttcactattaataattataattgttatgtaaaattgttgtgtgccacggaagtaaccaaaattcctagtcaattgtagctttaataatggctgtagacttttgtcatccacagacattttatcttgctttggtccttttcaaaaggcagtttataatcggatataatactctgagtgcaggtcttagataactttaaaaattatgctcttggaatagagggaaaaaacatctaaatgtggcaaactgatgtgttaaacattgctaatccttttgttttcagagtcaacataacttatttctttagagctatttgccacttttaccgagtgagtaaaatacactcagtgacaaattttggagcaaatttgtttctctctacctgatttctctagaatttggaaaccatttgtgagtattctcaatttatgacagtatagttaattgcatacgtgcaataagaatctgttttcttttgtaacaggacaccattggagaaattggtcattttaccaaggctttgactggaatggcatgcttcctttaaagaatcaaagttgacttatagagccatttaaagcccgttggggaatctggcctcataccttgtccacacagagtccctgtacaaggttcctgacctgtggtaagtaaagaatgtcactttctaacaggcccaggaaccccaagttatcttgggacctcaagaggagaggactttggtcaactcataggtatttgagggtacaaacccatggctgggctcggctttcaaaaagtcttatctgagattcttcatggaacagagttccatcaaagccaatttaaaaagcctaagtgaaaaataattattcttgctgcacttcatgcaaataatcaggccaagtacagtaagactaaaatgcattttataagcaaatcatttctatcatgatttgtttttaataaaaatggggactgaacagagaaatattatgcttcaaaagaaaatctatagtaaactattagctattcttgaggttaattcttcagtttagactaaattctaaattgtttgtgggttagaagttcccaaactaatgatttcaaatgtttgcttttaaaattgggaattgtacttctcatcctaggactcattataccttatagtaggctattcacataaacactgtagtaaaactatagatgagagtaataatgtttctgccacgcaagccttggaagcccaattaggcctgcatgaatccactcaaacagttgcaaagcagttccactcttctcaccttggagttcgttcccattcccgctacttcccccatcagcaggaagaagccagagcgatcgacggccttttcccatctttatagcctataccttagggttaaagtgttagaaaacccaaaggaagggattgaaaccacctttgcaaaattaggtctgagacagtgaaaacaatctaacttaactgactccatcttgcttctaacctccaagctgtcttcgttcattcctgggcataggctgaactaactttgggagaaacttagtttacagtttaaagatggtaacagccctttcccagagcaaaattccttcttgcctgggacttgcgtttgtaggactaacatcagccacagtgttagaaattatggtttaggagtcatgcagctggaggcaacaagattctgacccccaccaaactgctcctaagatcagtgcttgagatattttgcagaccctgcacttgatggatcagctggcaccacccagatcaataaactggctcatctgatcttgtggcctccacccaggaactgactcagcgcaagaagacagctccgactccctgtgatttcatctctgaccagtcagcactcctggctcactggcttccccccacccaccaagttatccttaaaaactctgctccccgaatgcttggggagactgatttgagtaataataaaacttcggtctcccgcacagctggctctgagggagttactctttctctattgcaattcccctgtcttgatgaatcggctctgtccaggcagcaggcgagttgaacctcttgggcggtcacagttttgacctagtaaagctttcattttcttgctttgccctatggcctaatttataatatacataaccaaaagccttagcttctagtaaatagtatttattaaagtgctatataaacgttacattttagggtaaccaacttttcttgttttatttttgtttgtttttgtttttcaggaatttctcagttttaaaatttaaagtcccatatcccacaaacctgcttagcccccaggcacaccagacactcgatcaccctaaagttctagtttattttgggatccttgcatcccttaaaattacatacaagatgttgggtatacatacatactgcaattgccatcaggttcaccttgcccactctctagacagagttgatttatcaagacagggaaattgcaatagagaaagagtaattcatgcagagcaggctgtatgggagactggagttttattattactcaaatcagtctccctgagcatttggggaccagggtttttaaggacaatttggtgggtggggagcagccagtggtcagaagtaatgattggttggatcagagatgaaatcatagggagtcaaagctgtcttgccctgagtcagttcctgagtggggggtcataggatgagatgagccagtttattgatctgtgtggtaccagttgatccatcgagtgcagggtctgcaaaacgtctcaagcactgatcttaggctttacaatggtgactttatgcccaggagcaatttggggagaagcagtatcttgtagtctctagctgcatgactactaaaccgtaatttctaatcttttggctattttgttagtcctacaaaggcagtctagtccccaggcaagaaggaggttggttttggggaagggttgtcattgcctttgttttaaaccataagctataaactaagttcctcccaaagttatttcagcttacccccaggaatgagcaaggacagcctggggcttagatgcaagagggagttggttacatcagatctctttcactatttcagttataattttgcaatggtggtttcaatacctgaatgcattttcgtaagacaaagcttcaatgccaaaacatctaagatatcccaatacggtattaattcatttgctcggtattaattcatttgctgttgctataaaacagaatacctgaaactaggttacttatttcaaaaaggaacttatttcttacagttatggaggctcagaatgtatctgcacaataggttcttctttcctgctgcccaggtagagctgatttatcaagacaagggaattgcaatggagagttttatacatgtacagccaccagctaagcagaagatcagagttttactattactcaaatcagtctcctcaagaagtctgaggctagggttttcaagatcggtttggggaaaggcatgtggaaagctacgcaataggtgcttgctgctgactggtagggattgcaatcataggactgtgggcaagggtcctcctgtgcactgagtctcttctgggcggggccacaggagcagttggcaggtgcaggtggagccatcagtcatcagacatgaaatatatctgaacagatatctcaaaaggccaatcttaagttctacaatagtgatgttgtctgcaagagtagttggggaagtcgcgtgtcttgtgacctctggaataatggctggcaatcctgtatgtctacaccgcagcagaatttagtttcccctatcctcctagcctggtggtctctcattagctctacaaacgcggttgagttttggggaagggctattgtcatttaaactataaatgtctcccaaagttagcttggcataagcccaggaataattaagagcagcttgaaggctaaaggcaagagaggagttggctagattagatccctttcacttccatcattttctcaccgttataatttttgcaaagaccatttcaagaagtcccaggtcaaaaggacacatctggtgagggccttcttgctggtgggaactctctacagggtcccaatggcctggggcatcacatggcaggagggctgtgtatgctaacttgctagctcaggtctctcttcttatcaagccaccagtgccattcccatgataatgcattaatccattaactcattaatccattagggcagaactttcatgatccaagtgcctcttaaaggcctcccctctcaatactgccacactgggggttaaattttggaggggataaatagtgaaaccatagcaaccactgaatcaaaggagttaaatgctatttttaaaaatgatgctaaaagacaaaaaaaaaaaatatagtgttaaaagaaaaacttgagccaaattaaagttaaaggagtttaattgagcaatgaacgatttgcgaatcaggcagccctcagaattacagcagattcagagagactccaggggtgccttgtggtcagaataaatttatagacaaaaaaaagtaaagtgacatgtagaaatcggaagtgagatgcagaaacagctggattggttacagctcgctgtttgccttatttgaacacagtttgaacaatcagcagtgtataactggctgaagaatggcggctgggattggccaagactgagtgattgtcacaggcccatactcctaagttagtttttcaatcttgtctacctattgagataggttgtagttcatccacagggactcaaatatagaagtacggagtccttctcaggccgtatttagtttgctttaacaatagactttatgggaaaatggtattttgttaaatgcaaaataataagttagagaaacactttagtgtttataatttttaatattgactgttagccttagctgtttatttatttatttatttatttatttatttatttatttatttgagacagagttttgctctcgttgtccaggatggagtgcggtgatgcgatctcggctcactgcaacctccgcctgccaggttcaagtgattctcctgcctcagcctctcgagtagctaggattacgggcacccgccaccaagcccggctaattttttgtgtttttagtagagacggggtttcaccacattggccaggctggtctcgaactcctgacctcaggtgacccacccacctcagcctcccaaagtgctgggattacaggcatgagccaccacgcccacctgccttagctgtttaatatgtaactcatggcttggtatagttcctgagatttggagaggcaaactgaggtttgaatcctgtcttcaaacttattggcagttgggcctgatcaagttgcttaacatttttgtgactcattctccttacatacaaagtggagaaattttgcctatttttaaatagaattgtacaggacagagaaaaatgtattttaagcctcttagtgctttgtgatatatagcaggcaatatttaaatggtaactattattattgataatagtaagtatgtatttatgtgcttcacagttttacaattaaacatgtccctctcagggtttcttactatattcttacctagagctgtgacatattaaaccaccttgcaccaaaactgaacaattggtatactgaggataaacattacttttttattcagtagatatcactggataattttgttataaatctctgacagtaaagtgaaagattatgtatatcagttaaaactgataaataacattaaaaagaaatttctgaattgaacatcttttgctctaaattttctggccaaatagggatacctcaaaggaaaatggccggtgaatttgtatacagataattaaatagtagttttagtcagtaaatcaggaggtccaaataataagtagaaccagggacatagcatgatggaaattatgctgcccagttttcaaaaacattgatggtaataaacagctgtgtaacataaaagctggtatgagaacttggtcaaattctttttacctgagttgagaaaaggtatcatctccccatattctactccaaactgatgaaatgctcaccgagctgctccgtagcctggctggttacctcactgaaatttcacccttggaggccttatgaccttttaacttattccacagctagattccaccattatccaaatcaatggtgcatttacaggtgattcagaagttatttagagaagattctgacatgttcaataaaaattccaaatttctcaggaattacttttagacatctctaaatgaataacagagaggttatgtgaaatccttgtgtaattatctgtgcccagatttttttgtcgttgtttgtttttggtttttgaaacagagtttcactcttatcgcccaggctggagtgcagtggtgcgatcgtggctcactgcaacctccatctcccaggttcaaatgattctcctacctcagcctcccgagtagctaggattacaggtgcctgcgaccacacctggctaatttttgtatttttagtagagaaggggtttcactatgctgaccaggctagtcttaaactcctgacctcaggtgatccgcctgccttggcctcccaaagtgctgggattacaggcgtgagccaccgcgctgggcctgtgaccagatttcttaaccatcacatgcctttggacttgccattcaatgttccatttagtagattttgatacattgaaaaatcactatgaacacattttcaagtctagctggcttcatttttgtcctctaaatggcactaaatagaatctgtgattgtgacagtgcctttgctttaatctaccagctatttttgaaagatatataacttaattgaaaaatagtacaatcttttcacttagaatctttacgaaaaatgtaaaagatgctttgccagtctgaatagttaattgagtttgactgtaccgggtaagatgcaaaagagtgtgtctatggcaactctttatctcataaaaaatttaaagggcctttatttaatgtgactccttttaaaattcatttaatggcgtaagtaaaactggatatataattagagtctaagataaaagcataataattgaaataagataatatgaagaagctcacacaacaatgattgggcttcaaatgaatatattctttaagctcagctgaactcttgtaagttgtattttttcactatgatgtaataataatggtatgtggatgacaattatactactttataaatgtaaggtgtcttatagtgtactaggatctttcctatgcattatcaaatctgaatctccaattagccctggatatttgtatatccttttttttttttttttttttaatcaggacagagtctcactctgttgcccaggctggagtgaagtggcgtgatctcagctcactgcaaccactgcctcccagatagctgggactacaggcatgtgccaccacacttggctaatttttgtatttttagtggaaacggggtttcaccatgttggccaggcttgttttgaactcctggcctcaagtcatctgccacctcggcctcccaaagtgctgggattacaggtgtgagccaccaagtccggcctgtatgtccattttttagaaaaggaaactgagcacaaagaggttgagtaacttgttcaagatcacataattagtaagtgataaagtcacactcaaacccaggtattctaacttcaagtataatgttcttttctctgtgttccttctttgtataatagagagcaatgagtatgtaggaagggcagaatagctgcacagatctttacaatatgtctcacaataatgctgtgctttcaaaagacttgatttaatcattttgtttcctcattcactggtctattcattcaggctaagggggcccttttttctagatagatttgctttcaccatttcattcccttgtcaatattcgccatcttagaataattgtgttttcattctcccgcttgaaaaaagatgcttaggtaattctttatttaagaagtaaagaaacattatcaatattgatatagatatgaacatatatatatatatatatatatatatatatatatatagagagagagagagagagagagagagagagagagatggatagatacagatatagatacctcaaatccaggaagaaggaactagattttttaattatacaaaaataaaatactcttttttaatttttttcttttaccttttgtgttctttacataagatcaaatgaataaatacatttatttaataaggaagcttattggtagttcctgtagtatttactgtctattaagcatcaacctaggaattgtaccataacttttgtttaaatacaattcttctattgatgcagtaagagctgtcagtcatagtgctgggaatgccagaggggaagtcatccctgacaacattttttattgcactattaatacgtacaagttgacgttcaagtgtgtgtatgtatgtgtgcgtgtacataggcacacagaaacatcatatatacatgtgactacgtaaaaaaatacacttaaacatatctgtttactctgtaagtgaataatcatttatttcaatgtttagatgagattttaacatattagaatggcttcatttttctttctaggcaatctgctagcaggctttttccagcaacctattcttcccccatctttttgatattataccaagatttctgcctccatttttgttgatgtaattatcccggcataattttgaaaaaagatttcctggcaatgtaaatccacaagattgttgatatggcttgagctcaaatgatgcttctatccgatttgtttacctttcagcttgagcagagttcttgtttcataagaaaaacaggaagagatactatagtagagaaggacttttatggatggttttattttaagtaaatattgcctgtaagggatccaggaattttagtgtttttcttggattccttaaccataatacttagcccagagcaaaactttctctcaaatgatggtaaaaaatctaattctattaaatcctgattattctgtgagctaccttggaatacattgcctatgagtttttctgctaagaaatggacttcgtttattgctcattttcccaaaatcaaggaatgctgttgttcttcaatttagatagatgttgacaaggtcctcttcatagcagcaggtgttaggctataattgctcattatagaattatgttttgcttgaaggaactcaggaaacaagaaaagcatgttttctgtgtatatgaattctggttgaaaaattgaaagaatgacactaggaatagtatgtaaattggcagaatttgtcatttcattgtgcaactagtattttaaaaggcaataaatcaacgtgaacatccttgggaaatcagtctccttcttaggcctaacttgcaaagtacccccttaccattgtatttttttaagatagaaattgagattagagcaacacggggagcaaaatattggcagatgaacttgttgaaggagatgaaaaacaagaagctatagaaatagattggccaatagtgctgagcaactactcaactgcaaaaatggcttgcttttccaagcaatgtgtaaagcaattagcaccaacgtttttattagtttacataaaataatattactttgtaaacacctataaacagagattacctagatagcctaagactattattaagtacaataaaacgttactggtttaaagtaataggtatagaactttgtattgtatggtgcacattcacataactagagaggaaatggaggtctacaagtcaaggttgaattacacacttgtaatccatccttaagggaaaaagcttcactgatcaagatggtactttgcacaaccttgccaattgtttcacaaagctgtaatgatgccacaaataatctttcacctcccatacctaagtaaaccatatttgagttattttctctgctccttcctatacctttcctctttggcatcacaaagtcagatttttaacctacaggttgacataagccaaaaatgttggaagattataaactgcctctctttctctcactgtatgtgttgtgtatatgtgtgtgtacacatatataagcacacacatagatagaactcacacggaaacataagcacatatctacgcactgttgttttgctaccatatccagtgataacgtttattttgaattacatgtattttttttctgaatttaagagtgaaatgaaatagagttttgttagatatacagttattacctatataaaaatgattctgtgcatacttccttggcaaagtacaatacctcctccgctgtcactgccaatgcacaggtgttctttctcctggctgttagactcactgggagaacttagaaaaatatttcagccacagctttactctagcctagatcaattaatcactaccttggccttacaatctactaggcagtccttcccaaactctagaatacagcagaatcccctagaatgcttattaaaaatgcagattctaaagccccattctaaatgatattcttctggtaggtctttacaagtcatgtattcctggggtctttctttgagaaacacaactctaaaaggtctttgttattcccattctgggttttgaattctttctcgaaattgtaacaaaatatatgtactgaaatactgttcctctaacaatctgaagaaattttcagcactagcagcacttgttggcactattgttgttattttgtttaatatttaagacaactaaaagttacagtaatttataatgagaatcagtattatggaatcaaccattaacagttcatctcactaaagaatttttatttttattatttatttatttacttacttatttttgagacagagtctggctctgtcgcccaggctggagtgcagtggtgtgatctcggctcactgcaacctccacctctcgggttcaagcgattctcttgcctcagcttcccaagtagctgggattacagctgcccgtcaccacacccggataatttttttttgtatttttagtagagatgggatttcaccatgttggccaggctagtctggaactcctgatctcaggtgatccacccgccttggcctcccaaagtgctgggattacaggcgtgagccaccgctcctggcctcgctaaagaattaacatcatatgttcactagtactgaggttagttcccaaacactgcactaaaaaaatgaatgaaacaaatgaatgaaaatgtgtttccttagccatattctaagaaaatcacctctttgattattgtaattggaaccatctcttctttctttgcctggaatctttgtaacaaggttatcttctttcatgtcccattccaattagtaatcatttatttctattaaggcttttataatcattcggagaatccacactctttgtgtctgcagtcgctgagttcactcattaaatacagaattttcaacaaccctatttccatcttcattgttattaatacttcaaatttgcttctgttcagaaccacgcacttgtaggatcgagtaggtatacgtgttatccgtacacactctgaaaaactccctgcagacacttactgaacaggaattgcttatttaactgtgttttctgtctctttcatacatgttctctctctactgaagtgattgaaggatgacaaaggtccttatgggtgtttgatggcctgtgaatagctgtcggtctacgaattccctgaaaataatttctccacttgtatgaaaataatttactccgtgacttttcatgttgtattgtcaatcttccttctggttgtatcaggcaggagtcattgttttacatttcattctttagggggcctatgcttggatttctcccattgagaaaaaacaaagcataactctgacataatcgttggtgttaatatcatgaaaacctggaaaaactaaaggcaaggcaaaaaatatgcattcttatgcatgctttatgtgcactatgcccgtacataaacctggcagaactttaggcagaattaaaggtttaaatgggcatcatctatcctctataggccttttagtgtgcttcttatgtcctgaggaccataagaagatctaggagctgagtcctacctaccccacattgctggtaccgttgggggctctatgccattctactccagccagcttcctaagattagtctattacttttgtttcctttttttcttttctttttccttccttccttcctttttttttttttttttgacagagtctcactgttttgtccaggctggagtgcagtggtgtgatctcgtctcactgcaacctctgcctcccaggttcaagcgattctcatgcctcaccctcctgagtagctgggattacaggcgcgcaccaccaggcctggctaatttttattttagtagagacgcggtttcatcacattggccaggttggttttgaactcctgacctcaagtgatctgcccgcctcggcctcccaaagtgctaggattataggcatgagccactgcacctggccttattactctcgtttcctagacattattccacccttcctaatacttagctacctacttttgcttccgtttaaccctctgtaacttgttttaaggtggttttttttttttttaaatcctttggctatgtatgttcttataaagcaaaatttagttgtgtcaattcatgaaatcatattagcattcacttagaggagagtgagaaatgtttcctgctcatctatatagcattgcccatttgcacttagttttgatatttgaggcaaatccttcggttttattgtctaaacacacagttgtaattctaaggaattttacaccaggtcgaaggaggtagcattgcccttgcatactattatgtagggcattgtaatatgacatctgtcatatagtgagatgaggatggctacctctttcacttaaaatagctctggccctttatataaccaaagaaaatataactgaaatgcttggcaagaagtaaagttatgaacaatgggcttccagcatttgctgtatgcctgctggcataggaattccaagcatataatgggtgttctttatataatgaaaagccaattgtgagaccggcttataatctttggtgccagtaggcagcatgtacatttcataatttcatcctaatgttttaagtgatacaaaaatgtcctttttatctactaaagtgcttcacatgttaataaatacatgtaaatttctgtaaagtgatattgtcccttaatgaatcaaactgataattgtttctatctcattaaaagtaatctatatttgaaagtgaagaactctacaaataaaaatatttaacatatcaaacatttgaaatttctaggtattgtaagcacaaatatttatggtcatatttggccagaatgttttccttgtaaatagacttggaatttttatatccactattgtgattggctgtaataatttttcaagtactgtatacacaaaattataattacattttatactaactatgggtgggggctgtcaagtgtaggtaaacaccaatttgcctcatcatctcttttgtaaaacctccaaccaccaaacctaatcgagcaagtttatgcctcctctactgcatgttagcactttttccatgttaatgtaatatttgtacacaaacctgtatcatccaacagagcttctgagaagtagagacctttgcttattagactttcagttcttacttcgtagaatggtggttggccattccatacattttattttattttattttattattatttttttctgagatgaagtctctctctgaccccgaggctgaagtgcagtggcgcgatcttggctcactgcaacctccgcctctgaagttcaagcaattctcccacctcagtctcccaagtagctgggactacaggcacttgccaccatgcccggctaatttttgtgtttttagtagagatggggttttgccatgttggccagactggtcttgaactcctgacttcaggtgatccacccacctcagcctcccaaagtgttgggattacaggcatgagccaccgcgtctggccatcaatgcattttaaataaatgaactaaataatgaatatcatttaagtgcaattctgtttacatttgtttacatctatacttattttaatcaagtatattcggtggtgtcaacaatctgtagcttaacaattttaattgaaagactctaattacatatcactatataatagttaaatagttttcttggatgaaacaaaagagagtgagatagagaaagaagtaacaattaaaggatttcattatgtgatagtcttcctgtgtttttttttccttttagaaagttgccgcaataatagaaaatgtttatttctttttcttactagtagaggtggcatttttgctatagagtgagtgcccttagttcttcatttattaacaaatatttcattctatgtataaaaagtataataaaatcatatagacaatgttacatgaaaaatgaacggattgttattacaccaggaaatcactactgtgccctatcaaaatgagtttgaagtatatatgtgcatatatatgtatatatgggcatgaatctaaggcaatcaattatgtctattttcaatgctctgtgaagaaagaaattggttgcctactgtcacattttatcttagtgatactctttcattaaaatgcacacacgaaaaaattaaaaatgtaaaatctgattttctaagtggacttaggaaggtacagggaacaagtgctagtgcgtgaagtggaaagtatgagagtacatgaagttgaaaatgtgtttgtgtgtgtgtgtattgtagcaggtcatctaggactgcaattttcaaccatatgcccaagccccggcatagagatagtgattcagttggtctggggtggggtatgggcttaggtaatattttatggctctctaggtggttctgatgtgtagtaggggcaaagaactgcctctatgggtgtctaggactgtactgtaactatcagcaattagtgagagggttctttgtaatgcctttgattattcttctagagacatatgttctgtacatcagccggggagcaaaaccagggaattccagaagtggttctcccttaagacttactctgacggtgttagtgttttcataactcgagccttaccctcattctaggaaaaattataattattatctatcttactttccaccctcagtacttaacattttaagggatttagtgaatttttccacttccctttttatatttgttgcaggtaagtcctgttgaatatcatcctcaaatacatgcatattttactgccatggtaacattttctactttttcttctatttttttcatatgtaaattatcattgaaaatttggcagagtctctggtaaccaaagtaatcttgtctgtttctgtgctactagttttattataatttgattcctgttccaaaaatgaagtacagtaataataattttttaaaactcaaattatttgtaggtcaatattaatgactttttattaatgtatatgtatataggtttaacaataagtgaagcagcttataacagtatatattctattaagtagaaatttacacataaagttagaagaactccatgtgcagtgtcctcttatgctcatatataactttctgtttcaaataagagtttcaaaactagagtctgtgtggcacagatggtgaattgatgccataatttccaatctgcttgttagtagagatatgtcatatgtttattgatgattgcaagtatgtttggtgcattaaagcttcatatttagtattataaaaaacttaatgtcatgtggggaaagaagttgctacctttctaaaaattgtagaatagccaggctcaatggcgcacgcctgttatcccagcactttgggaggccgaggcgggtggatcaccggaggccaggagttcaagaccagcctggccaacgtggtgaaaccccatctctactaaaaatacaaaaaccagccaggcgtagtggcgcacgcctgtgatcccagctactcgggaggctgaggcaggagaattgcttgaactcgggaggtggaggttgcagtgagccaagatcacaccactgcactccagcctgggcaacagaacgagactccatctttcaaaaataaatagataaataaataaaaacaaaaattgtagaataaactccttgaattccaggaagaaacaaatattgttgtccagttatgcaattatgcataatgagagttaaatgcacaaagtgatcttaaatgtacatattcaaaaatagaggttggatcaagaattcagattattcaatatcaattcaattccttctgttgtgccatttgaatcctattgccaaagatgattattcatcttgaaaaacagactcccaaattcagagttcctgcattttaatttgcccttatgaaaggaaggattctttccttttctggaatacaatcaacttctgctgagaagaaggaaagtctttattcaatactgaaaatgtgtattttcttaccgtctatttatatggacaataatcaaacttttaattatcttctcacaatacttacagatctatgagaagagttgctatctaaagctggatctttatggagaagagacatgctcaagtgtagcgaataatttttgttacatatcagtattaactaagctttgcaaagtgaatagggaaacttatatttaaaatgtcagggaaaaaaagagttttaagtaaaagggacacctggaactctaaagagactatagctctaaacctgtagctgaattctgccttagatttcgttgacccttaactaggggcaaatgcacaccccattctcagggtttcccacacacctctggaaggaacacaggagcgtatttacagctatcgtctaaccattatagaattcctggggacaaagttgtgtcagccacctttgatttgtagtaaacaggtacaaaaccgcatcatggaattatttctgcttatataatcctcttctgcagtgtctgaatcttggcacctcctctccttcctcctaaccactgcaaaaacaacacccagattaaggcatcggggagaactgaatatctgaatatcaagtactccatatatattgatccatcgaatatgcctacaatatcactactaacctacaagtgtaccaggagttacacctgcagtataacagattaaaacagccttctccaaagctcatcactttgaatgttaaaagattcattttccaccacttaaaatctgcatactatgatctgtgtataaaaagctaaaagatatatccaatttcaaatgtaatgtcatgcaagtgtctactgaatgtgtatatatctttgtaagtgtccctgagcaaaataactttcaacttaacattctttttctcttggatataaaagagaataacgtaacaagagcaaatttgcttttaaatttctgccttgatagcaagttaaagtatttagaaccaacatcctcttaaatgtataatttatataacggatgagtctagaacagcatttccaaatggaaattgtaaagaacattgatcccgtaagatgttgaatgaaaaacaaattgttaaaatgtgataatttcatttccttctttagcgagtcacaactcaaccctgaaatgttttgtagttaaaaaaattgtttaacttagtttaacccaatgtttctgaacctacgtcacaaaggaaatgtttttgtcaagtgatacataactttcaaagagattggatttttttttttttttttttgaaatgaagtttcactcttattgcccaggctggaatgcagtggcatgatcttggctcactgcaacctctgcctcccaggttcaagcgattctcctgcttcagcctcccggttagctgggattacaagtgcatgccaccacgcccggctaattttttttgtatttttagtagagaaaggggtttcactatgttggtcaggctggtctcgaactctagacctcaggtgatccacctgcctctgcctcctaaagtgcagcgattacaggcgtgagccaccacgcctggtcgagactggaattttttgaaacacattttcataaatgaattactggggtactctctgtttattaactatgttagtactgacaaagattatttgctcggccaaaatttattcaggcttcccaaccttctcatagcccagtctgtgcacattctcctaaaatttagttttagcaggccagatcagtttagccagaaaacactcatccttggtatttgattatcctggatatctgatcatgttcctcatcatccaccatcctccaggggatgactggactattttcagcaggagtctcccttacccatgatgcttcctcttaataattttccatccactgacccctaccctgttccttggttataaaattcccatttgcctgtgctgtattcaaattgagctcaatctctctcccctactgcaagaccctattttcacggtccctatacctattgagatggtcttgaataaagcctgccttaccgtgattcagcaagtgacattgaataattttttctttaacagtataaggatcgcacattaccatttgttttgaaagatggtataaaaagactaactgaaaactaatcttggctgggtatcactggcagaaattcttggtcttcaatctatgtagaacagatatttgcattttcttttgaaaatttaatacattgattaaattgtcattttgttataaaaatatgaaatgaagggtacatatgatttttaaaaatttctgtccaccatcaccaaccactatgtgaaaatacacctttgtaagactttttctattctataacataccttcaaaaccaagaagaagtatttgtaggaaattcattgcttttatttgtgaattgataaagggaaaataataagctagggctcgagcttcagaacagggtgatggttttatatctctctcaaaagtactgcaaggtaggttgtttcaatactattaacaaccccagggttccctgacatcttctattcccagcttccattctcaaaaattatatcgaggccatgagttggactcctcagccctagcaaaagattattcatttgctctgtaacccttcttgaaccccttttcctggtagctgtgcccaataaatccgacttatatatctttgggagttggagagagagagagagagagagaaagaaagtgagacagagagagatagagggaaattattttagctaagaaaatttacagtcacaataatatgagagtctctgaataagggataaaagaatattagacgagacatagtctctgccaatggtgattaagtaaacatagtcaaggagaatatggctgtgaccattagtgtgtaagtggttacatctggtgggcaatctccagtcataagtaaaataatctacgagtgagatacaggctaagcaaagatttcataattaggaccgaacaagcactaagtacaaagtcaaacactgataaattgagcttcattaaaactaagaattctatctattataatacactaataacagtgaaaagaaaagtcatggactgggagaaaaatattcacaagacgtatatctgattagaaaacttgtatccataatatataataaactcatacatatcaataaaaagacaacccattttttaaaagttggcaaaatatttgaacaggcacttcataaaagaggacaaagatggtaaaaaacatttgaataggtgcctaacttcattagtaatcaaagaattttgaatacccctatatatgcatccgaatggttaaaatataataagacaatatcaagtattggggagaattggtgcctcagctggagctctcaaatattgctggtttaagtgtaaattaatatttgccaatatctactaaatctaaatttatgccttccttatgagccagcaattcctctcatatgtatgtgttcaaaagaaattagtaggccaggtgtagtggatcatgcctgtaatcccagcactttgggaggccaaagtgggagggtcacttgaagccaggagttttagactatcctgggcaacatagtttgacctcatctctacaaaaaaaaaaaataaaataataataatcaaaattagcctgacatggtggcatgcacctgtagtcccagctactccagaggctgagatgagagaatggcttgagcccaggaagttgaggctgcagggagccgtgattgcaccactacactcctgcctgggacagagtcagaccctgtctcaaaaaaggggagaaattaagtccaccaaaatagcatgcacaaggtagttaatagcaacattttgcataatagcagaacctgatataacttgtgtccctcagaattagaattaaaaatgcggtatagactgggcgaggtggctcacgcctgtaatcctagcactttgggaggcccaggagggcggatcacttgagatcaggagtcagagaccagcctggtcaacatagtgaaaccctgtctctactaaaaatacaaaaaattagccgtgtgtggtggcaggcgcctgtaatcccagctactcaggaggctaaggcaggagaatcgcttgaacccaggaggcagaggttgtagtgagctgagatcatgccactgcacttcagcctgggtgacagagcgagactttgtctcaaaaacaaaaacaaaaaacaaacaaaaaacaaaaattgggtatatccgtggaatattatatagtaataaaaacctgctacttggaagaatatgaacgaacttcataaacacaatgttgactagaagatgaacatttactgtgtgattccatctatatgaagtttgagaactggccaaagttatctataatgattcaggtcagcagagcagtttcttcctgagaggctggtgggaatatagtgtgaattgggaaagagcatgaaggagacttacagggtgctgcaattgttcagaactctttttccttgatacttgcttacagaaatgtgcagaatttttatttcacctagttttctatgcatgcgtagaatctccatagaacacacattttattaagtacgcattcaacttcttctaaaatacctctagtcatagaaaatgtaactttatttctttattccttactttgcctagcccaagctcctacaaaaaaaaagattagttaccatttaattcaaattataaaacagaaccagtcttttaaacagtatcggatacacaagtatctaatctaacttccattgcctatcagtggatgtggctttaatcaagtcttttctaaacaagatggacaggcactgaagaaaaaaaaagtgagccattttatgtgttttaaaatgataatgtgattttgaattttgctattgtagaagctcctaacaatattatctggcatttgttctatctgaataaagccatggcttatattatgtatatatggaatttcccagaatactattgttagacacatcactgagctgtgaaaaaaaaaatcatctctaatttgatcaatatgtacttacacgtatatcattagttgccattgctctcagcctttagtacattttttatgagccccgtgggccatgagcttgctttttcataacagagaacgagaaagaagaaatctcatcagtataataatacccacatcagtagagggcatggttcagaggcaatcttgttgtctgtcacagactccatgatataagctagaaatgataaagagattcgttacaggatactgtaaaagggatattatggtatataaactcattaagtgttaactagatcaaagcaaatatggcagaaaagagtctctgaatactgtagcagagtttattgaatgaatgaacgaacgaatgaatgaatgaatttataaaaagcgcaggggggccggggcgcggtggctcacacctgtaatcccagcactttgggaggctgaggcagacggatcatctgaggtcaggagttagagaccagcctggcaaacatggtaaaaccccgtctctactaaaaatacaaaaaattagccgggcatggtggcgcatgcctgtagtcccagctacttgggaggctgaggcaggagaatcgcttgaaccctggagacagtggttgcagtgagccgagatcgtgccactacactccagcctgggcaaagagagcaaaactccgtctcgaaaagaaaagaaaaaagaaaagaaaaagaaaaaaaaaagagcgcaggggtcagataattgagttagaaggtagaggagtggggatgttaatgcccatgtgagaaaagaggaagaggtattgaaggaatccagcggactttgatgaggaccatgcgggactttctattttcaggaacctaagggaacatcttgctgtaggcagcctggggctgtctccatcaaagaaatgctaatatttacattcattggtttttgttatgtgactgtctatgtgctaaagctgtggttctcaaagtatgtttcagacccgcaatatcacctggaaatttgtaagaaatgtaaattctcgggctgtgcggagacctactagataatgaattctgggagaggtattataagaagttcttcaggggattttgatatagtctctaggttgagagacagtgtagtagacaatacattcattactttatttattcttctccatgattctataaaagagctattgttactgctttgtttacaaatgagaaaactgaggctttgaaagaggctcagtattttgttcaaggtcatatagctggtatccagagatactgggaatagaacccaaatttgtcagactataaaacacggtgctttcagccactcctccagagccagggggataaaaattcattaatttccatgagtatttgtaatagtagcccgcaagtcctggaatacaattataactgctacagcattacctttgaggagaaaatatctcatttccccaattgattgccaaaataaaatgcttaaaatacaaatgtctggttgaagaaaccctttaattttttttcttgcgttcaggcatttgtgtcaggtttaactaatttattttaacttgcaatacagtgttgcctgtagtaacaaataggacattctgctattagtttttaatctcctaccgacttgttattttccactcctgaagctaaacttctttaacaatttctatgctcattgtatctacttccttactcacgtagctacctcaaacaccaataatccggctgcttccacatccttcaactgaaattgattttgtcacggcccaagtcacatcaggcctcatcttaccactctgtagtattgattgttgatcggtccttcctattggaaaaactcttcttccctggcttctaagatattccactattctagttttcctgtctcagggcaactttatcattttcttggagggttgctctcctatcgtaaatctcttttaacgttgagcttcaatcttaatgctcaatcaacatatttttcttgatctcatcaaaatccatagcaataacaactcttaaccatgaccctcagatttttatatccaaccaaaatcattcttttgagctagagacctatccccctgcccatcagttatgctcatgtatgtcacatagttaattcaaaatcagtatatatgagatcaaaaactgccttctaagcaattcttcctccttctctagctcattgaaagacatcatgtgccaaacttctcaggtttgggggtatcattcttgcattctccctcgagatcactgttctaacattaccttggcatcagccatcatgttttgccaggattgttgcagttcccctaaaacagatgttcaatttcccccacccctgtgattcagttttccacatgcagccagaatgttttaaaaagcatattcgattgtgtcatcttccccctagaaaaccttctgcggtttcttcaaaataaatttaactgaataactagttgacttaattcaatgttttccttcgtcacactaattaatcagtattttcatggtcctcgatgctgagggcttaacattcaagaataaatttgtcttatgtttactttaacttataaacttcctttaaatgaaaactaattgttaaatgatttgcaaaataaccagaggcacaaagtctattgtgatcagtggatatgacagaatatattttttgttgttataccatcactttcacaaaactatggaatatatatataggcatataggtgtgtatgtatatatatgtatagatatgtgtatagagacataatttatagaaacattcgtaataaacccctgccaaacatattttgcacgtttgaaatattagttgattggatttgtggtttgtatgtaagttgaacaattaactgatgtgatcattctgtttccatggctgttaccttagtttataccaccttttcacctgagtgattacaatagcctcctgattccttgtctctttatttgccacgttcccttcttcaaacttcccaaatccactttcccaattgttatcaaaaagagttttcctaaaatgtaagtcagataatgctactcattatgccaaattctcattgccccaaaagtgaaatctgaattctataagatgctctaccaatctctccattaattggcctctgcactatctctttacattcaccccttcccacccaccgaacccacccatccctcaagaacgacattgtacgtactaatcatgtcatacaagtcactattctagcttctgttattcttctggaaatgtcatctcccacctcaactttttacccagctaactccagtttatcatttaggtgatgtctcctttttggaacatacctagaattgacgttacaggaggaatatctcttgtgtgtcatctcaacatcccacagtaactatttttttttctttttgttttctttctttcttttctttttttgagatggagtcttgctctgtcacccaggctggagtgcagtggtgtgatctcggctcactgcaacctccgcctcccgagttcaagcgattcttctgtctcagcctcccgagtagctgggactacaggtgcgtgccaccatgcccggctaatttttgtatttttttagtagagacggagtttcaccatattggccaggctggtctcgaactcctgacctcgtgatccgcccgcctcagcctcccaaagttatgggattacaggcatgagccaccgcgcccggcccacagtaactatgttttaacatacatcaaaccactttgcaatttcctgtttacatgtcattatccctcattagtaagcttctaaaaagtatgggcatttatccagttccctatcatctccctagtccccagcacaatgcctgacacttaagtaattacgtgagtaattaaatgagtaattatgacacattcaagcttgttaaactctaaaacttggaaataaggcaaaagaacaagtagatgttcttttattatcatactaaaaagtattgtctaaaagatctaccgacagatagtttaatttgttagggacatgcgtctttgtataacttagtactaacttaaaagataatttttttgtgggtacatagtaggtgcatataatttggaagcacatgagatattttgatacagacatacaatgcatagttatcacatcagaataaatggggcatctattaccttaagcatttatcctttgtgttacaaacaatccagttatactcttagttatttaaaaatgtacaagtaagttattattgactatagtcaccctatagtatttactattgattagggcttagattctgagaaattttacataaatgtacacatttttgttcagtagagagacaagtaatatctttctggcaccctcaaaatatataattttattgcactttttgatgttaatctgttttgtttctaacttagcaatcttgttctagcttctttttctttctgtgactatgtgtgttcagtcccttgaattcccctttgaatcagttttaatttgttgcctgttttgttattagttagttgaataaatgtttccatattatcaggatatgtttataagggaacagcaaatttacttccgtgtgttttaaactatatgagaaacactgagcttggcatcaatagctaattctaggggagaaaaaaagtcattctcgtatatatttggaaaaacagtttttattcctttttgagatattaacagccatttgtatgttgaagattctgagaaacttggaggtgatttaatctgttttgctttgtttaatctaaaatttcaagattattttggttctaggaaattttgctctagaaaaaacagtttggaaacattggtttacttatagctttaaagaacaatattttaaactacaattcttgtgttcgaaatgctgtaaaaatcatttctattaagatttatttcctctaagtgttttgcattcaaataaggtgaaattctgggtctccaaatatacatttcagaaaagtctttgtttagctgtagggaaggcatcctgacttctcatcattatagtcacatagatacactagatttaaaggatatttaggtcgggcgcggtgactcacacttgtaatcccagcactttgggaggccgaggcgggcagatcacctgaggtcaggagttcgagactggcctggccaacatggtaaaaccccgtctctactaaaaatacaaaaattagctgggcgtggtggcacttgcctgtagtcccaacttcttgggaggctgaggcaggagagttgcttgaacccaggaagcggaggttgcagtgagttgagatcgtgccactgaacttccagcctggggaacagagccggtctccgtctcaaaaaaaaaaaaaaaaaaatagagcgtaattatatattttccttattttaaaagggaaaaaatactttccttattttccatatagagtatatcaaaataattacaatcattaagtaaaactaacatttacctgtggtctaaaaaagtcggttgaggccaggcgcaggggctcactcctgtaatcccagcacttcgggagttagaggccagtggatcacttgaagacaggagtttgagaccagcctagccaacgtgatgaaaccccttctctactaaaaatacaacaattagccaggcgtggtggtgggtgcctctaatcccagctacttaggaggctgaggcagaagaatcgcttggacccaggaggaggaggttgcagtgagccgagattgaaacactgcactccagcctgggcgatagagggagattcagtctcaaaaaaaaaaaaaaaaagaaaagtcagttgagatagtgaagatccaaagatatctgctaaaaaagtgtgtgttatctagttttaaaaagaaatgatatgcaaataaaaacattagtgagcagttaaatatttaaagggtacgttacttacattatgggtgtaaagtgtaagtggatttctgaaaacatgagcaccatgtgaacttcagtatttaaacaagtttattgcttttggcttttggatttattgtttttttgaaaatgggtctgagaacggcctagaagaatgggtagacttgacatctaagtctatctcaattctgctcttgagaaaagaggaagaaattgctcagaatgttctatcataattttcttcttgctctttagatttctaaatggctacacaggtattgagaaacacatttttatcttgttatgaacactaaaattcattagccttatatttcctctttccttatagctgtgtcttgtttttgatggcttaacacttttccattctaatcaagctttgtcatgggctatgggctgaagtgccttgtgatggactgatttactttcagtccctgtaatctgtgcccttgaaggctagaggttgaaatcattaaggctctgctgttgcccttgatctctgctcaaagaggctagagattgattggttgacagtggttgacctggacgtctcaaaatgaagccgtgatgaaggaaaatcaagtacacacgttcagaatatttcataatgacatttattctgcgtgcattttttccagcggtatttttgcttctttttttaaaaaaaatctagtttaatcatttctagcccaccctcaccactaccacatgtttattccatttctacattctggggcacttaagaccttttaattccttgaattagtcatttataaatgttgtctgaatattctatcaaagcaaggcagcatagagaacttattattacacacttatcacatgaaaaaattatttattagcaaatatctattcagagcaaacattttgatcaaagttggcctcaattcactaattagttattatgcaaacataacaaacatccaatagaataaatattcactcttttctacagttttttttggaatggtttcagtgctggaaaaaaaaactaaaccaattcatgtaagaaaaagtaaatgtctgttaagagaaaagaccacttttaaatacacgttttaatatttctattttaatttctacttaaaaaggttaaggaggaatattctaaagacgaatatatttgcaaatactgtgggaacactttattgaaccaatttgagaactaagtcaattatattgaatttacatatttggttaaagaaaaaatgagaagtgattagattagttcaatatttaagtgaacttaacagaagtatccaagttcatgttgaccctattgcttcgtattaatattgataattacaaatatacatatatattaattttcaaaaatatagattatgagtgggtaataatagcttctaaaaattcactttggtactattccatagtggccaagtttccttttgttctctggagggaggtggcctaatttaggcaagtttagtatttagagcaaaaaaaaaggcagtctatgcagagattcaatggcatcttaaacctgccccacctatctctcattttttacattgctttttcattatcttttcctttcctttcgagagacttgaatttaatattgtctctcttttccccatgtttgccttttataaatctaagcatttctgccattaatactgtaggttaagaaagtggcagccaccatatttaaggaatagtaaaatctgtaactggggaaatatacagtcttctgagaaactgaaataaatttcaggtaaaaagtatgtgacgtcaattgagtggtgcacgtcgagggatacaaacctaaatacattccaggatgaaaatcgtgataagtttggagctccattttcagggaagtttctgtactgactttagaaacattgcaaccaaacaaatccttgggaactgtagaaaggactctttttagtgttcaggctaagtagacaatgcctacatatttaaagtttcatttggcagacttgacacagtaggcttcatggaacacaagttatgccttccttggtctgagagagagaagactagttctgctcaactgaagttaagatctgaggttcagtgagtccatatagatatcatggaagattgagtgaatacactggccctaaagcaacagaaagagcacaagttgagatacagttttaatccccaatgattggaatcaccactgccagatatcacatcctaattacacattctgcccttcaagctctggcaatacttttcttgcggtgccccctttctttagtttgccatatgaagagtgtggtaattactttccctgcagttgtttaccagttctcattcatttttcaagttttcctttctctctctctccttttttttttttttttttttttttagatggggagtctcgctctgtcagccaggctggagtgcagtagcatgatctcggctcactgcaacctccacctcccgggttcaagcgattctcctgccctcagcctcccgaatagctaggactacaggtgcatgccaccatgcccagctaatttttcttgtatttttagtagagacgggatttcaccatgttgggcacgctggtcttgaactcctgacctcaggtgatccacccgcctcggcctcccaaagtgctgggattacaagtgtgagccaccgctcccagtcgaatttttctttctctaaacaattttcagtgtaaaggtctgctgtgctataaatttgtgacacatgattgtgttgtagttacgactacgtaaggctctatggacaggtttcctttagttctgccagcacagctaaccagctaatataaatataaagaaatgcaactgttgacaccaaatgcagtttccgtttgcctgaacaatcaacaaataaacacaaaatctgaataaacattacaatgtgaatctatgtgtctgtatccataattatataaaattgaattattctaaagaattctatgtttcttaacaaaaatattatatgcatatatacagttaggtttaatagatttgtataagcatttctaattcttagcttccattgatcttcagtgtttcagaatatttatttcaaatcacttttggaagaaagtaagtttacaaattgtgaaaataatacacaaatcagagatccctatttaaaactaatccctacatcgcttcatcaaaatgcctaaaattcttttttggaatgaaattcacagagaattgcaagattcatttcctttacacttttattcactgccaataacttggggatactaagagtgcaggagaagcaggtaattctgagggcgttttggaggaaagcagttttgcattggctaagtttttaaaaaagattaaacatttaagtgccttgttttaaagatttgaatgataatgatttcaggtaattgatttttaagctatatggtaataataagacaaaaataattcatttgtttccttttggaaaatagattttttaaaagataaagatctgttttaatttttgtttttatttctaaggtactgtccaacctaaaaatatgaaagtaggtgtgcataagcttttttaaaaaaaaatcgccagtagtacaaacaaattttatagtccatcatttgcagggctggagggcttgccatatttaaatgtgtgacctgttttgagtatttgggtcaaagagaagggaggcaccagtgtttaaagtggcacaaacagagggaagaatgaaaatacaatcgaatatattcatttttattttcataaataaaagaaagtttaaaaaatctaggtacatcagtaatgttcccttagatagtattattatgtggctattgtttactctcctttgtcagcaacacgatcagtgattttcagcacctgctattgggttaataatggagttagagaagcatgagtttcaatttgtgctcatctactgcaaagtagctatatgaacttgggcagttacttaacctcgctaagctttgtttcctatccatacaatagggtcaagagaagtacctctcttacaaggtctgtgaaaatgaagtatgttcatgtgtttaaagtgtttagtaggtggcacatagtaagcactcaaattatatggactatggccattaccttgacaaactatattctctctccatttcctcatatgtaatgtggattaacacgaagattaaacttaaaaagtgcataaaaatctcagtgtctagcaatttgtagatgttcaacattattaaaattccctcctcaattttgcttactttgctgtactgaatgctatgtgagataggaaaggatatcaattatttgctatgccccttccgggcactaaataaatacatgtttttgttcattcttttactcaatctaaaagttattgagcaccaaataggcatcaggaagtatatggacaagtataggaaacaggattgatatttacaatcaggagaacaattttgagcccccagtcagtcacttgatgttatcctgggcaatcaatggatagagtccaaccactctaagcctcagttttcttatttctacatgttgatagtattaatagttgttataagatttgaaacctgttatggactatagtattttgtgcagacattagtcaaaatcataaattattttggggagcacatttacattcctcacagtgaagccttgggccctacacctttgcactaaattatacatctgtagcaggaaaaaaaaatttcagtatcacacaaatttaagtgggctaaaaatggtattttattaatttttctatagctaaattaaatttctattttggttcctcttttaatttaacaggtttcttaatataccattctcaggaaatcttaataaaattcagtgacttttcaggtctaccggtcacattcaggagttgttaggactctagcctccactctaggattggaataacacaggagtattacttagcttcatggcatcagggccaacttctgattctaggtcaaggacacacagagatgtgacatccaatgtggtctgtggggaagaagatctttgcatgcaggcattggctgaagtgaaccagtacctgcatcccgcccttagttgaactgcctattctgcctccaggatttggggtgtctgtgtcctgattaccacacccttgaaagactgccagcttgctcctcctaacttccatgaccttctcaagcaccgacacatgttagctgcttatcacaaacctgatgagatgctcagacccctgtgaggctaatctacatgcccagtccctttgctctggttgggcactatttttcagcagctccagaacctccttctcttctttaggactttggttccctaagaggacattataatgttcctcttatttgaaaaggtgtgtgtgtgtgtgtcagagggtcaggaccctccccacacccccacacggcttctagctctcacttatctgtaactctctcaacttccccctcttcttctcttggtaggcacctagagcaggtaaaaacttttaaacaggattcttctatatctgtttatgccagaatcatggttcacttacactaaaagcagttgacctctgtcagtgaaatcaagagttgattttgtaattcaagagctctgtatttataaacaaccctaaggcagtgaggaaacagtgcctaacttaccttacttgcaaaggatggaacttaagaatgtggttacaatctcacgaaatacttgtgtgtgtgtgtgtgtgtgtgtgtacgcacctgtgtgtgtgtagttctgaagatggcattgttaggtggtggaggcctataatattatgattctcaacatgtgaattgttatcacaggcaactaatcctattgcctcaggtttacaatctgtaaatgggaaataaaatgcctaatgtttgttctcagcctagttgtgaggattaaatgcaaaatacagcctcaacaaatgtgagttcccttcctcacattcccttgtaaaaaaaggactttccccaccccccttttatttagcatatcaacaattactcctttatttgggactgaacagccttttactaactatccttttgtttctcattttttatattcatgcatagtacaacttatgaaatattttaccccaaatcctcttgggtctgctttatatgcataaccaaataaggcatatttttatacaactattgtgttttatcttaaggtaaatttcaagctaaagtgaaaaatgaattccttctggtattcaggcagaattttccttacgagaagtaggtcaagaaacattgaacgcagaataaatttatctctgaatacggctcttcagctctggattgtttaaggatggcctagaatctacgctgagcattctcttgcatctcctttttcagtatggttctgaattagcactcgggcataaagcatttccttggaattgctcttatttttgtccccatattctgcactccatcgtcaggtaagaaggcaatatgtagcagtcatttaagaaaccagcacataaattatttccgaagttaaatcaatgtgcatcttactggttcagttcacagttaactagaactgctggggcttgcttttatgaattgtcccattccctccttgctttctttttgagactgactcttgctctgtcacccaggctggagtacagtggtgcgatctcagctcactgcaacctcctcctcccgggttcaagtgattctcctgcctaagcctccctagtagctgggattacaggcatgcaccaccacgcccggctaatttttgtatttttagtagagacggggtttcaccacgttggccaggctggtcttgaactcctgacctcaagtgatccacctgcctcggcttcccaaagtactgggattacaggcatgagccactgcgcctgggctctctcttttaaacaatcataaatatgaaattaaatgggctgactggaagcaaattggtctgtaggaacgcccatgaaagtgttccattctgattgttttcccatcctgcagcccctctggcctagtggaagctcctttcgttttgcagatttagattaactggggtaggtgagagagggcagggatggcaggccatttgtctctcatcaccgactgaaaagttgagcctaatatataccttttgctcctctacccaaatgaattacaaaattctaattccctcacacaccggggcctgttgtggggtggggggaggggggagggatagcattaggagatatacctaatgttaaatgacgagttaatgggtgcagcacaccaacatggcacatgtatacatatgtaataaacctgcacgttgtgcacatgtaccctaaaacctaaagtataataataaaaaaaagagttgattgtttttataatctaaaagtaaagacagtttggttttgtcaaaacttctttgttttctatttattttctctatagcttctaaatttgtgttctgcttgtgcatgcgtgtatgcttgcatgcatatgtgtgtgtgttttccttaaagagtaggcaaaaaagggcagaaaatagatcattcccttataaacctgacaagtacctgtttgtttctttcactgtggtaactggaaggctggaaatactgagcacttcagtagtcattctaaaaagattggttcatgtttaatttgtttgactgcccaaacctctaatggttcagtgaaaccttcgtgaggattttaagaaatagatcaggtgatagtttcagttgaagctactaaaaaaagcctttttgttcatattattttattagagtgggaaattgggaattctaaaatgttcccacatttgtcacccgtgttactctggcagccttttgtcatgttcacattttccctgttcgtttgttactgctgctgaatgtactttaatgattctaataggagctatagattgtgcagaagaataacaagcttcaaattaaaaaagaatatatttgcattttgtggcttctaaatattaatacaattgaattgtttttgttgaccactgtacattgacttcccagggtccggtgcatagcaaattcatagatgctccataaaataattatagaaccatgcattcgtgtgtgctgtgttgtggttctgggtactaaggatgtctgcctgagtcctgaatgagtcttaatctccatccaagttgtgtgtttcagagttgggatggtgcaaggaatttgattattaatgtaaactttagataactcatagcatgaataacaactgtacagtagaagaaaaatgcagaaagaataaaaaacacaaacaacagctaaaacaacaacacataaaaaacctcaaataattagagcaacaggctgtgaatgcatttagcaaacatatacccttcacttacttttgggaatccagtaactttctcctctgagttcaatgaaaaatcagtagcacttacgggtgtgatcattaactttgtttacttttttagctttcaatgacattcacgtttgtgttgagatttgttttttctttcctgaacattttatcccattcgccaatccagaaatgatagaataggaaaagaacaactagggctttatgcaagtacagtaaaatctattgatgcccctctacaaaaggctgcaaattggaatggctgaaatcatctgctcgtcttttgtgttgcattttaggactatcaatgaaacttgaaatgatatattaatagaaagtttgaacaggaattatatattgaaaatgtgacagaatgggtagatccaatcatcctaggctgttgagaagggaatatgcctcacagtcttgtactttttagatgaagccttccaatttacctggcagcccacctcatggctcagtgtttagtcatatagcagaggttgttacaattacaaaagttctcttttttttccatggaaaattgatcatttggagcagtagattaatttatttcaattttaaagtatgagaggcatagaggtacattaaaaagaacaaagactttgtagtcagagacatctaagagttgtgtaaacctgagcacataagtagcattttcttatctatatgatgggatggggttggggtaagaatatatatcatataggcagttacaaatataaaccacacatcacgtatggattttttttttagatgaactcatttatttgacatattaaattagacaaagaaatatatatgtaaccagataaaaacaatcacattctcatactacttgaacacaccgcagtggtcaaaaataatggattgtaaaatggaccccaggatttaatgcaaaaaccaccccatacgagaaaagtttcaggcttctaacttcactgaatccagtactaaacgtgcttctttatattcctcagcttcttccaagtctttttcactttctaatatctgttgaagatccaaatatgcggcttccaacctgcgctggcaatctgggatcatcatccgggattcttgtaggatctctgcctgctttttgatgtcataattttcaccatcttcagctctcattttttcaatcttttcttcttgttgttttgcctctttttcatacatcactttttatttgaccaaccgcttcaccacaccggtcttgatcttgatctgtctcacgcgaggatcggccatggtccctcgagccccgcgagaaggaggggcggaaagccggggtaaccgtggagggcgacgcgcagaggcggtagctatttaggcttggtcgccggcgcgcatgcgcaggctgcgcggccacttaaggagtttttataataaatcattatagtgtcataccttccatcaaaggattgagtactcaggtgtgaacattggtaaacaatttttccaatattaacatctgtagtattttaaattatgtgtcattttaaggtactgttattctctttgtaatttaacattttttataatagaaataattttgcaattgctacattaacattttgagttgattattgcttattgttagcaattccattgcatcattttacagattccatcactgtgctgaaacatcccatctgtttgtgaaagttttggatgttttctttagtatctagatgaatctattccttatcttatcagtcagagatattttaaagtccttgtctgttagttcaagcatataggttatctcttagtctggttatgttgatggctttacttcttgataatgggtgtattttgcttagttttatttattttttgcaagtctcattttctttttagtgaatgttagatgtcatgtatagaagaaaaatagagaatgaggtaaatatgtttaatcttggaaataggtatagctttttttctgtcatactgctagtatggggtttgagtcagtggtgttagtattgagctggtttggaggggcgggggttgttgttgctgtagcaaccttcagaacactacagtcttcaaagacctccactgatgggctgctgctatcccgtgcttaatgtaatagtgtctgcggtcctaaagggatttctatcttcttgttccatcctcagttttcagcaagccttatatgcctgtctctcccctagtggtaacagatcattctgtttttattggtgcagaatcctgggccaaagaggttatcatactgctcttccaaagagggtatcttgaccctctctcagtggcttctaccttccccaacccctctgaacaggcgggtcccatgggtggtagagtttagtatctttccttcagtttagtatctttccttaaatcttacgccttttagaagaggagggtctggaaaatgggtttgacttcatgtttgtgtgtcactgaggggagcttcttcctatctcttgtcctacgccttacttttttgcaagttcccaatagaagtttgtggaaaagaattccagaatgagtgcagactccttcggtctgcatttccaaggatgctgaaatgtcataccagcccacacctgacttttaagaatgccttacaattggagctattttctttttcctgctcctacgatgactacttcttcctccagttccctgccaaaggtaaacctttcatgtatccagtctctccttggaggagattgaagtactttggctcacctcgttgccttgtggccacagctatataaatggctcaaaaaataatacgtttttatagatcaccctgctttttctcattgggtggagcaacgttcttatatagcatttttacatcctaagcagaagaggaacttgattatgatggaaagcgtaagtattttaccctcttgggatatccacattcgacatgttaatcattacagttacccttactttagatggaaacaatgaataatacttatttttattagagaaaggccgtagtagataagtgatattttaaaaattgaatttaataaaaatgtattgaggacctgttatctgtgaatcacccaatgggaaaagtcatgaaaagctgaagaaaacacttcattgtatttcagagcttttaatttaaaggtgaagaaaaaaggtgactcaaaagcattttgtatattcagaatccatttgtgaaacctaatttgtgatgttgaaactgagatttggcacactgtccaaaattgcattcaaaagtgtagaacctgctgtcctggcctttttgttttgtttgtttgtttggtggggtggggtggggtgggcgtaggaaggaaaaagaaaagataaggagtgtggtattgactgatagtttattctcaagtgcagtcaccagggagttcgaactgacttctacttttgaagttgaaacatggaagcagggctccaaaattttgtatctcattgaagtaacttagaatactcacacttttatgaatgattgagatacttcctaaaaatttaaaccatgatatctccaacaacggaaaagagggaatatgaaacccccataggctacgggtgtcaatcaaaatagtcttcggagaaatgaaatgttttcttcatttactataaaattgaagaaaaaatttcatttttcttttttttcttttttgagacgaagcctcgctctgtcacccaggctggagtgcagtgacgcgatcttggctcactgcaacttctgcctcctgggttcatgcgattctcctgcctgagacttgcgagtagctgggattacaggtgcatgccaccatgcccggctaatttttgtgttttttagtagagacggggtttcgccatgttggccaagctggtctcgaactcctgacctcaagtgattcacccacctcagctcctagagtgctgggattacagatgtgagtcaccgtgcccagccaaaaggttcatttctcaagttttacaaaacttttcagtcaaaattcacatatctactgtcacataattcatactcaattacattccttcaaaaatgctctcacacaaagtttgaacacatcgaggcaggtggtttgaaacatccatcccaaagttgagctgggagtcaaggtgacaagaatggcccatgagcagtgagatgtctaccaatgccgggctccggggcaaacaactaacattaagtgcaaaggattaaacttgttaattaggagaaaataaaagcaggcatttgcttattttattattgagtttatattaatagtaatcacttccattcatattagatgcaaaggaacttttaatattctatgcactgacttaaacttatttcttaatccctttcatctccttataatgatgcatatgagattattggaggtttggaggtatgcactaatgcaaagtgatgagctgtaaccaaaaagtaaccaagaaaataaaatcacaatttcatgcatgtatttatatttgtcttctatggcaaaccatggggatattgaaatatgaaatttcaaataccctctttattatgttagatgcattatttttaacaatagaagccttaaataaaatattaagatacatttgtattttgacacttaactgcccttggcattgtgcatttaaacttttggtgtctagcaaagttaaagggagactgtctttaaatacatatatattgatagtgccattttgttagacatgtcatctttcgaatgtaatgatattgttcacacattgattttattgatgatgttaaatcaaaatggtttctgcaattagtaacttctataaaacaaacatattaaaaggaaatcatacttcctattgtagtataccaatttatttttccatttaggaatagctatgctccctctcatgttttgttttgtataccttactaaattaaatattcattttattctttaccagtttccatcacagacacaatcagtattatttaaatttcagcaagaaactaaacaagacttacaagtttttcagtgctaatgatttttttttctcattaagtctgagtctaatgaaactaaacagaaagttctggttggattccttggtcacccctatctgtgtttgtgaattcctataattggcatgaattgaaagttcttgttatcactgatagtaacccagagacaattccaatttgggtttaaatggccctatgcagacaagggtaactgaacaaaccaaaacagcttcatgtgtttatggcagataaataccaattaagtactagaaatgacatcagggttttttttttttcctgtatagtttcaagttaagagactttttctcccttgagtttgcagatatagagcatcatgaccttacaagaggaaggagagcaacttcccatctgaatgagagatggaaaaattatatgaaatagaactaattctactgttaagcagtaaactacttattacttgagtattaattaggacacttggctacaaataacttataccaaatttgaactatctttatcaaatgtggaatttattccaaaggatacgtttattctaaggattaaaatgtttctcaaggcaggttagggcaaattgcagtacacctcagaaaatgcaatcaaaaccttccaggactctctgtcacatctccttctctctaaactatcttttttattgcagattggcttccgctgttcctcatgtagcagaccatgattgccaacattcccttatatttatatctcgcagttgaaggattcagggagagcctgattctaagacccaagtctaaattctttaaatacatacgtatgtatgtgtatatgtatatgtatgtatatatatatatacacacacatgcattcatgtttagatagacatacacagacatatatgtgaattacattgaattacatatgaattacatttctatttaatgtattcaatgtaggttacaatgcaacgttatagaccttttcatccattacaggtaggaatgtggtttaatatggaatttttgagaagtaatttgaaaatatgtaccaaaacttacggagatgatttttcacctaaatccattataatttttgagactcttttctaaggtaataatcccacatttgggtggaggctttatctatattgatagtaattgcaagactattttaatagcaaaaattatgagaccatttttcaaggttccaaaaaaaagcagaacggtaatttttatgggaacaaagaagacaatgcttctagatatttaaattgtgtttgaacaacattggaaaacctgttattttaaatgaagaaagtaaggtgtctaactacttgtgcaatgcaattacaattatgcaaggaaaatgcaaaggaaatatatcaaactttaaatcctaaagcttttaatactcactttttctctagtttctaaaatttggctaataaacataaatttaatttataaattaattgaccttggcattgtataaacatcagggtaaataatgcatctgtctctctgtctctctctcgctctctttattcaactttatcctaaagcatcatactaattacaatctattggttttagtttgactcctcagctaggttactcaaacaatgaaagactacttttaatctctgaagatgtttctttatcttgaattttgatttcctaatcaatgaatacttgtctaaatttagtattaagttcacacacatcttttctcttttttggattactttgccaatcaataatgttcctcttttagcggttactggttatttctactgatctctgctgagagtttattctcagacactttcataccacgctttgaaaatactggtttccaagctgtgaattcactgtatctatgcagaaaggagtgatttgtttcttgtatggcatgatgttttttatatcctgtgaaaaccatcaattccacatttgagtggttccttcatgacatgggctgctctaactaaagaaaaatgtgcattaaaaatatgtgtccgattaaggcattaaaatatcttaagcagtcaggtagcaaacaaatctttctgagttccaattactgtattacattatgtcaatacttactgtcaaagtacattacagaaaaaggctgggctcttttcagaaagggcattgcaatataatgggtgacaagaaactgcatctgtgtatatggaagcacaagaaactaacaacaacaaaaaaatagtgcccaatcctaggtggctgaagagtaatatctaagagaatatgaagaaaacccattatttattccctaggccagataaggagccctggctttctctggcatagctgcagtgtatataattatacctctttcagtgccaattactgtgtgtatatccataaaaagaatggtacaatggtgacagagatgaagagcagatctcttaaataaacatgtaaaaaaaagcaaagtaaagaaaaataataaaaacaggtctattgctgttaatgccactgttccagaaaaaagtaaaacagagatcattaatatccataagagccagaataatgtctatatttttcatccaacatttttcaaaccatggagcccttttagaatctgctgatgactgtggactctcatatatacacactcataaaattttgcccacaattttaggggtttattccatagtcgtattgaaagcccatagatttcaggataggaataacaatgttgattactcatttggggccagacactttctatgccatataaagataatggcttatttagtcctcacaacgacactatgagatagttattattttagtacctattttacagatgagaaaactaaaggaaagaaaagttatgtaaataaattgagaaaactcagccagtaagcggcaaaactggactttaaatccaggccgtatgattccagagcatactccaacaaggactgtaaactgcatcctgcagaaacaaataaacaaacaaaaacctagaataaagaagcagatgatagagttttagaactggcggaacacatagaaattatcttttccaaattctatgttttaaagttgaggaaattgtattccacataattaaatgattaacagaagcccatagagcaagttagtgttagagccagggttcaagtgggaacattcatccaaagctcatgacaaagctacaccgatattattatcattattctacaggtgaggaaacagaggcacactgttaataagtagcagaactacctttcgaacccagataggcaggttcaaagctaaaactaccatattactgtaattcaggaaagccattccctttataattcgtttagtaggcgctcggaatgatcaaatctttaaattagaaaattcgaatgtcttcaatttacaaactttggaaattctggagattctactttacaatcattttaatgttctctaatcaaaaactaatgttttcagtgtgctacaattcatgaattttatattcatatcagaatataaaattatacacatgcatatatgaactttatatgttatatatgtatgaagcttatgtatgtatataacaatatgtatatgaacacaacctgaatacatatgtatatatagataaccattcaaacattttaaattggctatagaggaaagcaatttgccatttgacttaaagtcttttgtaatgactagaatttaaaataaagtttacaatttatgaagatgaaataaaactatacttaaaatgctgtttttcgaaacagaaaattcccttaaaacctcaaaatctattgtttgttttatataataaaaatccaaattttttctacaatgtctaaatcttttgtaattctgttatattttcctctacaagttcaactcagtgatacctaagtgcaaacaataaggctagtatgagagctttttttttttgagacggagtctcgctctgtcgcccaggctggagtgcagtggcgcgatctcggctcactgcaagctccgcctcccgggttcagccattctcctgtctcagcctcccaagtagctgagactacaggtgcccgccaccacgcccggctagtttttttttttttttgtatttttagtagagacggggtttcaccgtgtttgccaggagggtctcgatctcctgaccttgtgatccgcccacctcggcctcccaaagtgccgggattacaggcgtgagccaccgcgcctggccaaaagttacttaatttgcatgccaacctacactcacatctattaaatgattagtcaatcaagatatagacaaaactcatctattggcaatgtacactgagggacgtgttctcggtgtagtcctgtcaccgatcttagtacagaaataaataccttttttaatccagtggcataataaacctgagaaaagagaagtctttcattaagaatcttggaagaagcagtcgttaaccacttgtcatcagtattagcaactcaagctgaataaaaattgattgtgtgactctggaccttctttgctctgccacttggataatctattagcattggcacctgattaactctcaaaactgtctcctcttttgattagctcccaggatttcttttgtattctcagtaataattttccaaacccttttctaaaagactgactctaatgttcttttactgactgcaaagtttcccgtcagtgctgaaaacatgtttggccttcattcctatttataatttttggcttgatctttcataaacactggcttaagacttccgtatttggtgaacagggagtgaatgattactccgaaactttatttctgttttaagtgctttcagtatttggcacaaggtggaaatgagcaggctcagtactgaccattgctattacaataactcactgcatttccttaaaacttattttccacttaaattgttttctacattgatttctgtctgtgctaatacttggccatgtatgagaacaacctgcttgttttaatgtttaaattttgaatggtatggtaaggagaaagaccaagatttaaaagataatatattctgaaagggcaatttttggaaagcttttaatacttcatttaaaacccattcttcagcttattttaaatttaatgatggaatacaaccctctcttttttaaatgaagaggttatatacattccatcattattgaattttattctatgggccacatttactatttacctgctatattagtcagctttattataggctaatgctctgtaaaaaacaaatccaaatctcaatgacttataagaacaaacatttatttcttattcacatgtcaggttcaattttgtattgagtacaggtcagctctatgcatctctccttttaggaacagaggctacctgaggcgtgtacttcccctgacaaagggaggaaggaccaagaaaagtgaaaacactttatgattcttaagcccctagctcagaattgacacactctcatatctgactgtgttccactggtcaaggcaagtcacatgaccaaggccacatcagtgagtgggatgtgtaatccacccatggtgaaccatggcaagtggaaaggaggaagaaaaagaaaccgatgagcaaataatgtaaactaccaacttgttcaagaagttctaatgcaattaaatatatagtcaggaataataatactgatctctattggcacttactttgtactaagtctttgcttaagactactttcgatgctttacaggatacctcatcaaagtgaagctaagagtttttttaccacgattatttcctcttttcagactggaaatcttgggtttggtgtggcttatgagtcttttctttctttgttttgtttgtttgtttgtttgtttttgagatggagtcttgaactcctgtcggggctggagtgcagtggcatgatcttggctcactgcaacctcagcctcccaggttcaagtgattctcctgcgtcagcctcccaagtagctgggatttcaggtgtccgccaccacgcccggctaatctttttatttttagtagagacggggcttcactgcgttgatcaggctggtctcgaactcctgacctcatgctgcgtccacctgggcctcccaaagtgctgggattacagacatgagagactgcacccggcctatgagtcttttctaacactgcataactagtgcatgatcaagccaagaaatgtgggcccaaattccactacagagagcagacaataacgatgctcctatgggccattctggattacatatcccatgcaacaattgaggagccctacagggcatgcttagcaattgttccattgtttttttttttttttgtcctttttaatacatagacttctgtccctcgtttattgagggttgcccctgggagaactaaatctctatcacttctggactgccctgcaaatgggcttaccaagccctcctaaactgaagaaagccttaacacaaagaaacagagagatgtggatgcttgtggtgaggaatcttcagcatccacagaatccgttcactatagttataggtgaactcagggatggctcggtgaaataagggatgaggcattatcctcatctactatgccattttattaacctttactccatagtgtaagttgagtaaatacatcttgtgatttaaatatccccttataatccaggccctgtgtttgaccatttgtctgtttctaaagcatctcattaacagtatgtttggaaatggctgttgtgtgtcgtgcacatttggctgtttgctttccttttggtttgcaaagaagtattttgcaacccataaaaatagataaatatacaccacagaacaatgtatttttttaaattttcaggggagaatttgaatcttttaaaagtaatattgagtaggcagctgtatggaaacaggcatctagttagcagttctgctacaatatccaagtagttaatttcacctctaaattacactggagaccttgaccttattttgatttattctgtcataattagtctatggttattactttaacaaaaataagtcatctttctcatgaacactaccaaagcacatttcaagtctgcatactaattaatagtaacttatttttactcctaacaagtctacacccacatactcatgtttaaacaagatgagatatttgaaatcactttataaattataatgcaccacagaaatatccattatttccattattactaaaaacttacttcattcttttgagcatgaggaggtataatttatgtgaatatcatttcatattttgtttttatctttcaaatcgagaagacttgaattttttgcatatttacaaatactataaaaatcctactaattattaacatggctgccacgtagcaatcgtgtctattttatgaaataatgtcatttatacagaagacccacgggaagttgtaatatatttggaagtaaagatttataggttttgtctatttttttctctttctcagcattaatatgtcatacatgtgtcacatttagtcttcacaattcagtatctttattactattaccatgaaacaaatagaggcaatgagacacagagaggttaagtaacttactcaaggccacagagataatgagatgtgaaactggagttggaactcaggttatttgactctgaaatgagtgtatgatgtaaccccggcctgcattgtatctaacacatgcaattttaagaggataagaattaactgtttgcacaatctaccagatggcactgtttttccaactgagaccacttaacaccttttcatatactcttggagttctgatcattcttccactctaatacatttcttcaatctcattgtcattatgtcctacttcatgcaacttcgattaattcttcacaagtatatttctacaatacttgtgctatgtttccaatgtatagagcattgcaatttttatgaatatacaactatgcgattatgttaggttctcaccataactccaatttgctaatggagcataaattctgtgattaagtggcagggaatgggagagaacttttattcaatatgagctgacatggctttccaatctggtttctgagtccaacaactccctacaataaaaaagcaattgacctacctgagaaagaagtggcgtttgcagtggaggcaaaggaacagacaggtcatccatagcattttacattgtgtcagaagcatgacagtcatgaaagatgaagtaaagggcaattatatcatattacagagtgaaattcacctagagaaataaaggcagattgtttgcaagaaatattctttctcttaattttttattcattgtagtgatgaaaataagtagcaatatttcagttccaaggctaaattttggggagaagtcattgaaagttagttttatgtctaatgggtgctcaatggataatttaggaaatgaattggtgacagaaggtctataattaacagagtagtttgagcagtatgatgaagtgcagggggaaagcattggtctaggacttagtagatctgagatttaattacagtattgattagtcacttgatttattcaacaaacccttactaagtacctatttctgcttcagtataccatgtttggtgccaggagttgcaaagacataataattctcccatctaagtgtggtcacatttaggaggtaatgagtgggatttgggctgcattattggaagacaacaaactaattttctgtttgtgtgtgtgtatgtgtgtatgtgtgagtgtaagcaagatgagatatttgaaatcactttataaattataatgcacacacaattaaagtatctgtgtgtccatacacatacagttaaagtatttatgtgtgtaacacatatgcataattagaaaaaagcctacacatatgtatatatcagaaggattgattgataagttatgccagggagataagtgtgattgtgaaaaccctcacattcgacctagatcttaatagtgagtgtcctcattctagggagtgcatgaacaaaggactaaagcaagaaagcatatgatttatttatggagaaatttggcttgtgtgactaaggcagacctggtagatgtatataaggtttgggatatgggtgactgccaacaggcctaatcgataatatgtttagaggagtacactggagtcaaattgtgaaggcccttatatgccattctgaataatctagcctgtaacctcatcagagaagctctggatttttcaagttagttctcttaatatatgattgtaacagaactgtagtttctccatcagggaatttagctttatcattgattatccatgatccaactcccctaactccacatataattaataattagtacttaccaatactaccccgtaaacacatcttgaatgcacctactccttttccagccccactgccattcattaatgcaagtcatgcttacttctcacgtggattataggtataatcagctcatgtgtcttcttatttacagtttatccccaaatattctctacactgtgaaatttatttctaaaagccaagcctgacattgctatttccctacttaaaattctgctttgatttcgaactgccctctggctatattttcaggctcttcataaataggttgatgataatttcactttttctagggtcatctctgccatttttatcctcctccaccatctctaggtctgggaaaggaccatactctttctctcacatcctgacactttcacctgctcttttgattttctggagttctcttttctaccacttgtctctctgctcttaattaactttcaaaactcagctgagatgtcacttcatcaaggaagctctggatttttcaaggtagtttccttaatatatgattgtcacatgactgtagtttcttcatcaggcaacttatctgtatatttgtatcaacatacccttttgttgtgtctgcttctctcactaagctagaaggaaaaaagctagagacactgcctttctcacagttgtttttctaccacctagtaggtgtcagtacacatttgtcacttaatagccttaaatatgaaatgtaatttattagtttcctattgctgctataaaattaccacaaatttagtggcttaaaattatatacatttattctcagacagttctgcaggtcagaaatccaaactggaacttactggactcaaatcatgatgccagaagggctgtgtacttttggatgctccaggggagaatctgtctccttgccttttccattttctagagaattcccacgttatttggctcacggccttcttcgtacatcttcaaaaccagccacctcggaccaagtccttctcatagtgctttctaattctccccttatgccaacatttccccccttttaaggacccctgtgattaaatcctgcccactcagataatctgggataatctccctatcaaaagttagctaattagaaagtctaattctatctgcaataattccactttgccatgtaacataatttattcacagatgtcagggattagcacgtggccatttttgaggaggcattattctgcctaccagagtttaatagaattaatatctgcagaggagaaaaatgagaagaggactaaaaagtaaatctggtcttcgttaacttaaaacacctttattgagcactactatgtaacacattctatgctaagtgctgggattacagctctgatccagacagtcactctcttggaaatgagaaaggatgtaggtgatgttattaagaacaacttttgtaggatgatgagcagtgaagactgcattacattgactgtaaagcgaatgggaaataaagaaatatctttgacatgaacagcttttctgttcttcgtgcagaagtttaattattttagacctcctcattgtaagctgaccactaacgtcacctcaggcggtagaaaaatcccataatcaaagactattactcagatttaatagaaagcatttttcataccattttccattgcagcctcctccactctgcactgccattttgtaatattaatggcacagtaaatccactttctaaatatgtcctaaatttgtttccttcctttataatgctccaaaatatcacataaccttatctaatgtttatcattaatcttccatatttttcatttttttctcatgtttgatggaagcagagaatagactgaacttaattgctctcccatattacttcatagttctttattttcttttctttcttttttttttttttttttttttttttttttttttgagacggagtctcctctgtcccccaggccggagcgcagtggcacgatcttggctcactgcaagttgcgcctcccaggttcacgccccagtagctgggactacaggcgcccgccaccacgcccggctaattttttgtatttttagtagagacggggtttcaccgtgttagccaggatggtcttgatctcctgacctcatgatccgcccacctcggcctcccaaagtgctgggattacaggcgtgagccactgcgcccggcttcatagttctttctttaagtgaaattaactcatcccattgcatttcttcactacgtgagtttctaaactggtatcaactttaatattcccttccccttttaaagatacattttctgtgtcacattagggatgaagatcttcaattaacatattaactagcccccaaggaaatatcatttaaaaaatgtttttctaggccgaatgtggtggctcatgcctgtagtcctagcactttgggaggctgagacagaaggattgatggagtccaggagtttgagaccagcctgggcaacatggggagaccccatctttacaaaagaaaaaaaattaaaaattagacagatgtggtgatgtgtgcctagagtcctagctactgaggaggcagaggtgagagaattgcttgagcccaggggtctgaagttacagtgagctgtgatggttccaatgcactccagcctggggaacagagcgagaccttgtgtcaaaaaaattttattttcttgtacagattatggttaattgctttgtgtaatgggaataattgttagtgtttatagaactgtttttctgtttttttttttcccccagtttttaaatgctttcacttacattgtttatctgatggcagagaagaggtcttaaggaggctctccagcatctcgctcctaactctcattgcaatttcattccatgccactccctttctcacattttagagtgcaacaaaacagaattgcataatgaatgagcgtgtactttcagtttcttatcactctgtccttgtccttactgtctgctcagtgagattcatctttatcctcctcctacctttattccttctttactttctctcatccttctgaactcaacctacccattaccttctccaaaatatcttttctaacacccatgtggctacatattcctttctccatgctcctataatacgctttaaatttatatatatttttgtttatgcaaaatgtttcatatttatctatgatgtgtctattatctactaggctaagagctctcccagactgaatcttgtttatattttcagtaactagtgcaatgtccaggtcatagtaagcattctgtaaatatttattttataaattattacacgagtaaatgatctcattatatcctgtcaatagctccatgagttaaagagcaattaatattctcatttcacagttaaagacgctaaggcttggcaattttaaggccacaattctaataagtcctgcaaagccactggaagccagttccacagatttaatgttccctcagtttgcccagtatcattcttctgcagtaacttgctcttgtgaatcaagaatattgcaatttaatatatcccacatttatattcctgagggactaaggaatataaaagttaataacagggtaaaagttcattgtactaatcttaaaaaatatgaaaggccacatatactgaataaaaataactttattagaaggggttaaagattactgagaggaaatacaatttttatgtcatgttagaaagctaattttatatgggatttccccgtagagagaataaaataaaacgttggtcagtttttgcaatttatgaagtagtggttcttcacttcttgacatctccagggaacagttttcaagtaaattttcctaagagagattttcttctttgcctctcttattaatatgcacatgcatgtttttattagtaaaataaaatcagttataaacaaaccctaaaggaaatgaaatagaatatgtgctgcttgaaatgactaaacaggagcatataatcattttgtaataaaacagctatcactttattcttttctcatttgctttgttgctgattgcacattaatatgttttactatagactatgtgactacagaaatagacatcatgttaacgtatcaaaatagtttctagaacaatttatatatgtgtgatgtgtatgtatggtggctttaggttaactaagggtatacagcttaaaatagtcaacttttaagcaatatgacaaatagcaataaaaatatatcaattcaagtaaatacgtataaaattttagcatactaaaataaaaattaaaaggcatatgaccacttgggaaaatatgtccattcactgactaaaagtgagtagcttaattttgatcgttaacttggattttatggttataggagttttctgcaaggaggtcagtgaactctatgaaactatatgcaaatatgtatgtgtagacatttttctatagagaaggttcattattttcatcagataatcaaatggagcccatgacttgaaatgtttaagaattaccaatatataattatctcattccaattaattttaaaatattaaatgctcaatagataaatgagccaggatgtaaacaagtattttgacaaaaataggaacatacagaataaataaatgcatgaaacatcttctacttcattagtaatcaaattaattatgattaaagcaaacatcaaggatctccttacatctaaacaaagcagcaataccgtaaaagactaaagcaacgaaactcctatgaatgacatacctgcggctgagatgataattcccaacctcattctttctgctaccagtagaagtgggtgtgatcacttggaaagtattataaagatatttagcaaaagtcataaaggttttcataatgttgaactgataattttttcgaagacaattataaaaacaaaaaagaagtgagtgcatgagcatgtttattgtgatttagtctctaatagcaaacaaaaggaaagagcagcttatatgagatttatgataaaataagtgaaaaagaaagaatattattttggttataagaaatatgtatttatggggaatttaaaagtgtggacacaaaaattttgattgatttttggatgttaaaatgtttccataatgatatataagacgaaaattgaaataccaaatatcaattagtaaatgtaaaagcattattatttgaagtattaacaaccatatcatccagcaccattaaagaaggctcattattcagttctagatcagttcatacagacaaataagttatgcattgccaaattccaggacgctattcacataggttacaacatacatggaacctccttgagttgttcaaaatagaagctctgatttcatggttgttttgcatttgcgttaatatgttcaccttttgtgactctgattatcttatggtattctgtattgttaattatgcaattataatgtaaatgatagatatctggtcaatgtgaaaagccatggactttgattcagaaaatctgtatcaagttcatttctgtcacttaatagctttattccttctcagcttgtgtttatgtataaagtagtaaattacatacagattgagaagacataattaaaacaaacttatgaatagtaaggcactaagaattgttatgtattttataataataatacaattaattgtattaataattattatgttgaagaaaatatatgctactataccaaaataagacaataattcattgaagacatttttcttgtattaaagacgtagaggtgagagaggacaactagcaaagatgtttatatgttgaagctcacatttagtgttatttacacagtaaataagtaacactttgcacataatgtcaaggttttcgtgctgccttcgatgcttacctaaaaattactccttgtccatataattgaaaagaataaaaattttattctactacgtatttttcacttaaaagcctctagattaaatcacttcaaaagacctcatattgagcttttggcagagggttttgggtatgtttcaaagacatctgaatgtatgctttcaactgactcatttactctctgctttctgacagaaagtacgcatgcacatgtaggaaatataagtggaattgcaaataaggtcatttacttttaggaatatatgtatatactactgataaatgatgcgttgaccaatcttcctccataaagtctatgaagatggtttaattttgaccatttgaaatgttccatttctttttaaaattattttggaagggctagtattaattttatgaaagtaaagatttgaaggaggctagaataggtttgaaaactattactatctgtttttatttattcacccttgtcaacaaaggaaatacttccatattgtagctaagatttatcatataccatatgaataatgttgatattgaacatacatatagaagcttgtgtgaataacataattaaataagaaaaatgtattttgtaatgctaaataaaatttctcacctaagatgacagtttgaaatttatttattcactgttatttctcatattgactaaaggaatctacttatagattagtattgtgatttaaagataaacagatatttttggtgcatgcatatatttgttatgcgaaagtgattccttatgtttttaagagaagcaacggagatttactactgaaaaatatatgagagcaaatatgattactttgtaaagggcattttaataacggttcttttaatccaagtagataaaatataaaatttatcaattttaaatatctctcagatgcattcatttactgaacattaactaatatgattatatttacaataattaaaaaaatagtcttttgcttggagaaaaacattttaatatatcaagattgatgatttttctgtccatttgacttaatactaatttccagtttaggggcaaaaagatcatttgtagaagcatgaattcagtgaagctgttttttaataatttttctccctaatcccttagtataaatctttggggacttttttctttgagtatttatatgtaaggcatgaagagtatcatttgcatttttatttgaaatgttctgacttttagatgaaaagaggtcctagaaattttagagttgtagaatctccccttccttaaagcatgcacgtatttgtcagatgtattttctgagctcttaatttgttcagacagtgtgctaagttctgggaagcaaagataactaaaccatgctcctgctcatcaggaaacctcttccatagtgagatcaggcccatgttagagtatgtagatgctgcaaaggaaggaataatcatttctccatggttgggtggatggcatggggaaaggctccgaaatagtttttcggagtaaatgacagctgagagtttcttttaattatactggagtatctattcataactggcgaataaatactgttattcagaggagactatttttttataatcatacagtatttgaacgactatgggtttggtcatattaattgtttttcagatattacaaatctgaggcgggatcttgctctgtcgcccacgctggagtgcagtgccatgatctcggctcactgcaacctccacctcctggattcaaatgattctcctgcctcagcctcccaagtagctgggattacaggtgcatgccaccatgcctggctaatttttgtattttcagtagagatggggtttcgccatgttggcctggctggtctcaaactactggcctcaagtgatccgtcctcactggcctcccaaactgttgggatcacaggcgtgagccaccgcgcctggccatttttcagaagtaattttaatttggatgccccaaaccagcatcactcatgtttaattccatttatcaatgaatgtaatactaaatgtaaaaaaacactaacacatcataatggaaagttactttggttgtaaaatatgaattatatttaaagttgcttcctaacttttatttttttattttgcattttagatgaaagagaagatgttcaaaagaaaacattcacaaaatgggtaaatgcacaattttctaaggtaagaatggtttgttactttacttttaagatctaagttgtgaaattttcaaaatggactatgtacctgtgtatcttaaaaatccgttttatttctctcatagtgtcattttattttagctgtgcaaatctggaaatattatgttcactcttatttaaggagtaagcagcagaagatatggcaaagatacactatttaattatataaaatgtatatctttgattcttcttgacaatgtgagtttctttaatgacatgagtcctcagagtttatagctgcaatcttccatcaagtagctagaatatgtcacccagcagaagaagatatgagggaattttgttgtgaaaattatcatttttttgtccctcttggtctttaccaagttcaagaaaagcaatataattgctttgggtgtattcagccactatagtttagagcatatttcaaatgattaaagacaataagttcatcttgtttttgtgcaggcttcaatccatactcttaatatttacttaatttgcaaatacaactcaatttttaatcaatagcgtgactctagatgattataggtggacacagagcaagatattcttaccttgaaaactagtattaggaatgcaatatatggaggtttattgggatgtcaaagtttaaaagacttgcattttaattattattctcgatttgggtaaatcaatcaaatgtttggtgagtcggttttcttatgtttccatcatgaatgtttgtatatgtatatattgattgcttaattgagacatcaaatctagataatggaaaaataaagctaataaaatatggcccttaaacccaaggctttaagagtggcatagttttgatagtggatattttgtttcttattgtaatgatttaaagagtcactaaaagtgaaaatttctactaaaatgcctgaaactcttaatagctatgaattactccctctatgggtctgattttgtaaaattcatgataatggagccaaaacaatccactaggagatccaatctcaaaagttctcccttttctatgacaaacatttttagaatatcgtctattctttgtggtatttggtagtagaatgttgccatgtactctttaatttaacttactgaattttaactaataaaagttcattttatttacttgctgaataattaacaaatttctattacagacgtaaacagaaacatgtattttaaaaacgttttttaaatcctcaactttttttagctaagtgaaataaaatataacaacacaaatatagaagaataaataaaaagtaaacctaggatatttaggaaagttattcataattctccgaatatttataagatggttatatatagtttaattgctgtatatactggcatcattgacatttttaagttttggaattctgaagcagacaagagacatattttcaaacaaacatacagacaaatcagaattgtgaagaaattttctgaaatagtaaatgtaacaatactctgaatctttgaattgaactagagtaatttttaaaaggtgtgtaaacatgacaagtactgtgtatcctcattcccgcaagttgaaatagatcttcgctctgtgcattaaccttttccattatcatttatcacaactcacctgttaatatagaaatcaaagcttgatatccaatccatcctctatttatatattgttagcactgcctcagagcaattcggtatatttttttctgtccttatgaatgcccatatcttaaaactgtaaaatattcacatatatgagcacatttattgttttcttccaaaatatttgcatcctctaactcaactcacacttttcatttatattacaaatgttctccctaagtctgttataactgatcaggagagtcaccattctttcaagtacagaaattctattatcaagcatatcctaggtgtcaggaatagaaataaaagtttacaaagacagaggagaaaacttatttaaaggtaaaatgtatatatacctgtgcactaacttctaattttgagaacttgcaaagaatctttttcctcttttcttattcttttctgtcaaaacttagctaagtgactgcattcttttagacacttttgaagaagatgggaatttagaggaagctagttgattcagtttaagccacttggtgaaaccaaaagataaacataattgtgatatatatatcatttggcaatttattgcatcgctgcatgcctttcagcagaattctagccctgtaggatacacagattagttgaagtggaatctcctgaactcatggaacctacacagttatttgggagtttttggttaattgataaatggagttagaactgagtgggctcagtgtgggtggtctgagaaggcagtaatctgagctagagggaatctggtaacctttatgaagaaagctctaaaatgtgagcccatcaaaggcaggaatgtatatcttctatataatctcattgtttattactagtacactatataaatataataaatatactaggtcagtagtacaaatcattaaatctatgctaactgtagaaacagaagaaaaactgggtggaaaaattgtgttgaagaagactttaaaaagagaaaaaagagaatgaaaaattctgtctgtgtggtaaattagacacaggcacacacacattcatacaactataaaaatgcctcactaataaatctaactcatattcatttttatagtcgtattaatgtctatctgtgtctactttaccacacagacagatgataatttttcattgccttttatacacacatttatataatatttgtaaattatagagagacaacaaaatatttccttgttattttgtaaagctacggaagggatatttaaaggaaataaatgtgattaaatgtatccttgttgttgtggcgtcatttgaagccaaatgtgtctttgcagtaaatctaactgattttccactttcctggtaccattttaaaaataagccctatctctttttaaaataagtcttctattaactttgattccaaaaaattctactagaatgtgatttatcacatctattatatagagataactgaacaatatttatctccacataaacacaaaaccatttctagataagattaattcagagtaaatattctttccatgtaatttattgatatgttataatcctttaaaaagcctcgtgtatactctatgacaaatatgattcgcattataaaaatcttgctcatccatgccggcttaataaagggaagtacagttttgaaaacatgaccaaaaataattttgtcataaaatgtgcttgatgtttgtgtttgagaaaaaattttatgggaaaaaatatttactgccagctcaattgagagagataaactatctcccaatgagtgatatgatggttttgatcctatactgaatttagtaatcatctttatttccatactcactcttctgtctgatttttttccaacatagtatgcatgtttgacttaaatgaagtagaaatgcataattagttttgtctaatgtcttcacaaaagcccatgatatgatagtgttcctggaccaaactgaggattgggctgcttattcttgtggcccaataacgagatgcagatgaacgggaaaaggagagagtttttatttctgtaagtggttacagggagaagacctggaaattatccccagaccaactcaaaactataaagttttccagagcttatataccttctacgctgtatgtctacatgtaagtgtgtatccatctaaagacataaatgattaacttcttctgatctgtaactaagatctgattcctgaagacattcctctggagcctcagtaaatttactttatctaaatgggtccaggtgctgggatgattacccttatcttatctccggctaaatcatggagtttgggggagttccttcagatgcccagtaaacttgtttgtggagtcctggggagtttcttcagacccccaataaagcttttttaattctaaaagggtcctgttaagaattccttcattatcttgtcatgcttcaaggcccaggaaaggcctgggcaaaactcttggtgggcttttgttaccgtccagcctttgtttaagggcgctggctctatcagcttttaatatgtaactttaccactcagtcagtgctgaaacagttgttgtggaggcctgcattagtgagacctggcctgccacaatagttcatttacctcttcattgccgcaacatatatgtccacattaaaaatccaggactcaccctctttgggcaatatcatgtgataaaataaattgatatgacatacttcttgcaagatttctttttaatttaccttttagccagcatgataagcatgatgtagggtaaattaacactaaacttttgagtcagtaaggtagcctttctttttttaacttttattttaagttcaggggtacatgtgcaggtttgttatataggtaaacttgtgtcacgggggttggttgtacagattatttcatcacccagatattaggcctagtacccattaattatttttcctgatcctctccctcctcccaccctccaccttccgataagctccagtgtgtgttgttcccctctatgtgtccgtgtgttctcatcatttagctcccacctataagtgagaacatgcagtacttggttttctgttcctgcatcattttgctaaggataatggcctccaactccatccatgtccctgcaaaggacatgatctcattctttcttatggctacatagtattccatggtgtatatgtaccacattttcttggtccagtctatcattgacgggcatttgagttgattccacgtctttgctattgtaaatagtgctgcaatgaacatatgtatgcgtgtcttataatagaatgatttatatttctctgggtacatgcccagtaatgggattgctaggttgaatggtagttctgtttttagctctttgaggaatcactacactgacttccacaatggtttaactcatttactctcccaccaacagtgtataagtgttccattttctccgcagccccaccagcacgttattttttgataaagcaggcttcttcacactactctctaccttaggagaaaacgttatatccatactttaatttatttgaaaagaaaggtgaatataaaattgaaattctctgagtcttatttttcttatatgttcttgcctacttgtaacaaaacatataataaaagggcattataaatagtaaatcatataaacacaaaatattcccatttttgtcattatgtaatgtattttctgaattgaattgaaaaatgcatatatttatgaatttttttctactgaatctctccttcttatttacttctattcttttccatgatgttacctggtcttcttgagaacatgatattttaattgtaatcattgtgttcctaactccataatttcatgatgctattgaaatgcacatgaattttgattctataacctagtttgtaataagccatatttccttgtttctctacattggttgaatctgttcctgcagcaactagtaaccccaacaatctgactggtgagaaattcaatctccgtaacattttgcattcttctacttcttcccacttccattccaaagggccaggtagagtccagaatactgtaagtgtcctggttttcagtgcattttggtcatagctgatatgcttaatagccaagtaaacatgactacataaaggacagcttgtccacaatgccctgccttgcttgaacacggaaggttttgctgatgatgctctgtgcttggtatctggcctctacagccatttaagtaggttgtctcagcacaacatttggaaactctgtaaagggagtaggatgttggccttcacaacttcatccctttccctgtgtttgaggaagctcattaaacctctctttaatctgactgattgcaaatttccactgtccccgaatcttaactcccatatcccaatagcctgttcagttgggacaatatatcaatccttaacatgaatctagattttcagaactaaagtttttgaagggtgattttcctctggatacttgttcatttctttattgattatggttttggctaccttcttggcatcaaacagggaaaacagagcatttattcatgtgttactatcctattacactctgtatgccaattcatgtcctcaacacgtacacacaaacacacacacgcgcgtgcgcgcacacacacacacacatacatatacacacacccagtaaacatattctatatttaaaatgagcttagaagtttttaaaaaaggatgatactgggacaaagtggcaaaacattatttcagtgaaggaggtaacaatatatatgtacctttccattgtgtaagtgaattctaaatctgtatatagctaacacatttatatataactattgtgcaatgtgcctgctttaacagaagtaatcgagcagagctattgtgccatggaaggttttacatagatctaaaatggctcctgtgcccctggcttcctgtttgtttttatctgataataggaagaattaaatcattagagcagatgacgtacagtgaactatgtctctggatgctgatgagcagcctgcacaagactttggtaacaattgaattatttagtgcaattattttggagagatgaatattgatacaggaaacttacggaaatcctcgtttcagaaatagtgaggattgggaactttttgtttatgtataccatgatgttaataatcctactgaaaattatatgtatatggttagttgctccaataatcatatgatacaagtattcaagatgagtaaaatgtgaatttatgtggcttgctcacagtaaataggagagatgaagctaggacccaagaaaatggactctaaaactcatgatatttccatacctattattgttgggacaaaaattccacctacccaataatgcatttttgggacaaatcatcaaattgataagtcctatgagaagcaggcaggggggttggagacagtgaagactcaataacaggtggtattaaatgctcgcttactcacagaggatttaatctacctttgaatgtttagtaaccccaaaatgcaaccattgtttaggaagttttttagttgattctttctgaatgatttctaatacaaatgcccctcaacttgtgtggttaggtccctataaacccatcataagttgaaaatatcacaagtcaaaaatgcctttaatatacctaaccttcgaaacaacatagcttagcctaccctactttaaatgtgctggcttaacactatcctagagctgggcaaaatcatttcacacaaacctattttataataaagctagctcatgtaattgattgaatactgtactgaaagtgaaaaacagaatgcatgtatgggtactcaaaatacggtttctactaaatgagtatcaccttacactattataaggtcaaaatatcttaagtcgagaactgtttgtactttaaatgttaatattttttacatactgcgttttggtgagtgaagtaaacttagtttgcagtagagttatctaaagtgatattgtcattttcaaacattgctttttatttctactactcataaacaaattattgtgtttacatgattatttgaatattaacttaaaacagttttatacgaaattcaaaataccactttactggcatgtgaactccctaacatctacacttggtgttaagatgacttgtcgaatgatgtgtttgtgtttggaatcaagatgattatactaaatggtttaatctactgagaaccattcccttgaatgttttcctgaaacaatctttgcaaagtacctaagtaacaaaggatattactcagttagtgagacaaaaatggattgtgataggtctcactgttttcaaagaaagacaaatcacttattgttaatagtaaagaagtttcttagaaatatgttgctgtttatcaacccagtgttactgagatcttgacaattccttttagaaggtaaatgttttggtctctaggttatcatgtcctgatacaagaaaattggaattattgattacacctatattctctggagtggtctcagtgccaagcatatttagcttgcatatgtaaatatttaccaattagcatgatagttgctagcaaaaaaaccaattctttatggctgatgggcctatccattatttatctgattttattttgctttctagcaaaacaacatacatggacattagtgaagcatttttatttagaaaagaacaattgacactctggtaccatcctatcagagatatatgtttactaaaataacctttcaacatttaacaaatacttattgaatgccagctatgtgctaatcatactgtcatacagtgatgaaggcataacccaacatggttttccctctccaagagattatcatctgagaaaggaaacaattgcatcaacaaataattaaaataaaacataatctttaatgcaatagaaatgctgtgggaacatagaagacagaatgactaattgcttggagaggataatagctttttaaaatatggtgacatttagtctggtgttgtctacgcagagacaatttcaagaaagatgaaggcagaaggaattgcatgtagaaatgtgtaataatcaaagaagtatgacttgtcaggtgagtagtagcaagggagatctttaggagtgaagaagagaggttgtgagagggcatataatgccattcttgaagaattatattgttgtggggctggttgagccaacaataagataatggcttagtcatgttaatttgcaacttctgattgaagactgtgaagctctaaaacaacaggcaatgatagaagaattagactgccccaccaccactaatgcttcatgcaaaatttggtctgaagtctaccctttacatttggcaatagacatagagacctaaaatggaaaagcaagcaggctaccatttttgtagagttgtttgataccatgcacactccaaaacgatgcagcaaaacgcattggaattacctagaaaatgtgttaaaacatggattgctgaggcccatagtcagagtttctaattccataggtctagggtgggacccaggaatccggatttctaacaggtcctcaggtgatgctgatgctgacggccaaagaaccacactttgagaaccacagtgttagaatttcagtaatttaatcaggtctgtagtagagaatgttggaggaaaccccactgaggaatttattgaaccctcaaaggggaatgacctttttccagttgagaatcaatgcaagtacttgatttaaattgggatttattttgtggggactatactcaaaaactgaatgagttaaaagactcaaaatcaatcaatctgatactgattgagcattcttcgtccaaaacgtttgaaaatagaaatgtttcaaattttggattttcgtttggaatatttgcattatacttactggctgagcatctcaagtccaaaaatctgaaatccagaatgctccaatgagcatttcctttgtgtgtcatgtcagccctcaaaaggtttctgatttgggagcattttggatttgggatttttggatttgagaggctcaacctatacctattttttaaaaaatgtgtatatatatatatatggatatacatacacacatatatatgtacatatatacatatttatacacatatatgtacatatatacatatttacacacatatatgtacatatacacacatatttgtacatatatacacacatatgtacatatatacacacatatgtacatatacacacacatatgcatatatacatacacaaatatatgcatatatacatatacacacatgtatatatacacgtatatatacatatatacacacatgtgcacatatgtgcatatacatgtatatatacacatgtgcacatttgtgtatatatacacgtatatatacacatgtgtatatacacatgtacacacatatgtgtatatacacatacatacgtgtatatacacacatgtgtatacacacatatgtgtatatacacatacacacgtgtatatacacacatgtgtatacacacatatacacatatacacacatatacacatatgtgtgtatatacacatatacacacatatacacatatgtgtgtatatacacatatacacacatatacacatatgtgtgtatatacacatatacacacatatacacatatgtgtgtatatacacatatacacacatatacacatatgtgtgtatatacacatatacacacatatacacatatacgtatacacacatatgtgcatatacacatatacgtatacacatatacacgtatacacacatatgtgtatatacacatacacacatacacacatatgtgtatatacacatacacacatacacacatatgtgtatatacacatacacacatacacacatatgtgtatatacacatacacacatacacacatatgtgtatatacacatatacatatacacacatgtgtatacacatacacacatatgtgtatacacatacatacatatgtgtatacacatacatatacacacatgtgtatatacacatatacacacatatatacacgtgtatatacacatatacacatatacacacatgtgtatatacacgtgtatatacacatatacacatatacacacatgtgtatatacacatatacacacatacacatatgtgtatatatacacacatacacatatatgcacatgtgtatatatacacatatatgcacatatgtgtatatatacacatatatacatatatacgtatatatacacatatatatacatatatacgtatatatacacatatatatacatatatacgtatatatacacatatatatacatatatacgtatatatacacatatatgtatatgtgtgtatgcatatagacacatatacatatatacacacatgtgtatatatacgtgtgtatgtgtgtatatatacacacgtatatatacataagtgtatatacacatatgtatatatacgtatatatacgtgtgtatatatacatgtatatatacatatatgagtatgtgtatatatacacgtatatatacatatatgagtatgtgtatatatacacgtatacatatatgtgtatatatatacgtatacatttatgtgtatatatacgtatatatacgtatatatagttgttttaggttataagacttaaaaatacttatctgatgtatatatatatttttaacaatcctagttattttgtgtttcagggcagataggtgatgaataaagatattaatataattgtgttcaaaggttagaaaaaaacagttcgttgtggcattactattgactgtatccgcaaatttctttcactgcaatcctttcatgggctactatatatttttcttaagaataaaacatttccaattgacctacagagtctttcaatctctcttttgtgctttactttgcttcagcagaaggatttcattttagtgacactctgaaggtcttcctctgtgcttcacttaagggtgttgcatttttaaccttaccaagattcctatggattcctagaattatatttcaaattatgatcatggtagccagaacacaaagaattaagatctactctgacagtaatgtactgatataactttaactgtagaaacctttcttgtaatgcacatggagggcagacttgtatgtatcttggaacataaaaggcagagtatggtttttaaaagggctttgcttatttgtatcctaatttagctaatttcactatgccagttctatatgcagagataagtaatagtaaaaatggacaaaaagtgatcaataaacaagtgatcactttcggtcttgtccagaattgtggccaggtgatgagtgcaaactaagagaccttttcattagaaatgtgtgaagttactctttggtttagcattagctgtcttttaatgagaacaaatgagagttgcagatgaatttgctaaatgtttctttctttgatttagtttacctggcctgaagaaaaaaaaatgtcttcgatctacaaggtctacggagagtacttttcataggaactagtcctattaaaattacctgcagttattatgtcagtcagagaataaatattttgagtatcatatctgtacttgaagttcttatcctttacaaataatttatatttaaggaaacatgctttgacagaaatacacatgaagtctacattctctatctatttcatatcaggtgctctagtgttttgaatataacagttaagagatcaagtccctttaatcataaggccctgttagctagcgagctaaaccaaagagggaaacatttagcaaactatctgacgttctctatatttgtttgtcaacttgtttgttttttctctctgcaagtagaatatagaatttcagagagtgacaagtgctaagagaaaaaataaagcaggataagggtagaatagggatatttcaaagggtaggttgccattttatgtagtgggtcctggaaaagcctcacttaagaggcatacaaaaaacctgaaggaaggaaaggagggcatcttgcaggtgtcttggagaagagagttctaggcagagggaagaatatgtacactctgaggagggagtgcgtgtttgtgggataacaagggagtcaagatggctggtgcagagtgactgaggaagagcggtaggatctgcaagtggagtggtattagaaggacaaatcagatagggccttattgaccattgtaaaggtcttggcttgtacattgtgggagattaggagattttgagagttctgaacagtagccagaaataatgtaagttagaatgtaggatgtaaaggtagaagtagagagatgagttagaggataatgtagtaatgaaggctgggtgtgtgcgtgtggctaggattaggttgatgtccatggatctggggagaaatgatcgaattttggatacattttgaaagtagatgtaacaggatttgctggtggactaaaaatggagattgagagagtggagaaaaacagttttagcttgagcaaaaggaaggatgggatggttatttactgggataagaaagactattgcaagagagagtttggtggcaaagtataggtaaatttcccatggaaaatcattgaaaataattttagttttagtatgtttttatggaaggagtatttattttcaactcctaaaatttatcctcaagaacaagaataaatacatttatctctattaaaaaataaggaacaatgagagatgatacaagtgcctctagcattgtatgagtgtgtacaaccagtgaacgttaacttgtaaatccagtagcagtaacttgatctttgtctctcttctgatctgatagagtgcaaggtctatgtctacattcatttttttgcatgtagatgtccagttgtttcagcattatttgttgaaaaggctatctttgctccattctattgccattgctcgtttgtcaaagatcagtaaactgtattcatgtgggtctatttccacactattctgttctattgatgtatttgtctattattttgccaatacactgtcttgattactgtcatttcatagtaagtcttgtagtcagatagtgtcagttttccaactttgttcttctccttcaatattgtgtgggttattctgggtcttttgcctttcatataaactttagaaacggtttgtctatataaggcaaggtaacttgctgtgattttgattgggattgcgttaaatctgtagatcaacttgaggagaactgacttctttacaatattgagtctttctatccatgaacactgaatatttcaccattcatttagttcctctgataactttcatcagagttttgtagttttcttgtaaagatcttgtatattttttagatttattcctcagtattttatttttgaaaatgttagtggaaatggctttgtgttttacatttcaaattccacttgttcactgctggtgtgtaagaaacaattgaattttatatattaatcttgtgtcctgcaactttgctacaattgcttattatttccagggttatttttcgattctttcagattttctacatagatggtcatgtcatctatgaagaaatacagcttcatttctacattccaatagatatgtctattttctttgtcttattgcattagctaggacttccaatatgatgttgaaaaagagtggtaagagagacatttttgtcttgttcctgatcttcctgagaaagttttcattttctcaccactaaataggatgtcaattataggtgtttttgttcatttttttatattgtcatgaccttgttttataaaatacaattatttctctcctaactttctgtggacctcaattataattttcccataattctcttctgcttgcattgctcatgttttctgtcttcttcccatttgttcttatttgctttattttgaggaactgtttctcattattgaagtcattcctcaaattacaagtgatcttagcttttggtttatatttaagtgtgagatactaacatttgataaaattaaaatctatttcatgattaaagtacatttaatataaaacagaattgaataattttgttgacatattatatatatatatgcgtgtgtgtgtgtgtgtgtgtttgtgtgtgtgtaaagtccaaaagtttgtacattacttaaagaagaaacatctgatgcattctggataaagacaggaaaaccatatgagtactacagctacctccattaatacttaacattgtgttgaaaatattagccattgcaaccagacaagataaaccaattcgaggcaaaacaattgcaagcagtggtaatgggatcccaatttacagatagaattgtttacctcaagagatcacacaaaacaataatattaacaaacacaaatatgaacacaaacaaataccaataaaataatttagtaagttagcagactataaaatttacaggcaaaatcagtaaaattcattttataggtaatgagctagaagtttttatggatggtgcacacccatttgcaacaatagcaacaacagcaaaaacaagaaacacatttaacaagaaatttcagtacctatgtttaaaactctcctgaacaacccaaaaggaaatcaaggagaaagatgctccttgttcctgaaaagcatggcttaacattataaagtaaactattgtttttaagttaatgtgtaaattaaaggcattccaatataataagtagtatttttttctggagttggataaattgattataaactttttataaaaaaatacacaagtaaaaataaccagaaaaacactaaaaataaatatcgatgaagggatagggaaacataaaattataaattaaaacttagggaaaactatcatattaaatataaattttcaataaaaactaacaatttgttaaaatgtgttttgtaaaaatatatttctatcagctgggaaggtctggtagtaatgagtatacctagcatgcagatattcattggtaagtctcattccacactgaaagaagtcacagctcattagaagaatatatgatacttcatcctggccaaggaacatagtgggtgagcctgcagcctttgttagagccataaggcaaggaagtacttcccaaaatttgctaacatcttgagttgttcatttttcttctcctgttttctttatgcttgtagagttacacctttttaaaaggttttcttcctgtcattttattggaaaggcttcaaataatttttaaaacatatttatagatgttcatactcatatattttcctgatactgaaagagaaatttatgcatttagtaacaataaatgttggcctagattttctctgatggtctcttcaagaatctggagcgttctctatctccacaaaggatggaaatgtttcatttcaatatgccagttttcaagtaaatgtgatttagtttctctcttttaagaataaagtcatagcagaatgctttatattactgattgtagtatcataacttacttctgaaacatcgaatacaattttggaaggtcagcaatgtcctgttaatatttaagtatgcctcactatataatatgtgcatacattctggaagaagcatttaaaatgaagactgtttctaataatatattaaacgagctatgtaagtagagttttatgatagctgatattgtgattttattcagagactatttatataagacatttcagcatatctgctaaagaacaaacctatcatctaagtcagtaaaccaataatttgaattaaaaaaacggacaaaaagaaaatacgaagcaacttgaaagatcattaaatacactgcctgatagttaagattctaaacagttacattatatgaatagtttactgtatattatatattttctatttccactttgttataggtaagctaatcagatgtctcaagttataaaataatagcactaacttataaaagaagtgctacctttcttccactccccaaaatacacaagattttattcttcataaatgataacatttgttgtttgttttctgtggttgaaagggaagtacaggaatgaaataatgtattttgcaacaacttggatagaactggaggccattattctaagtaaagtaattcaggaatggaaaaccaaacaccgtatgttctcactcataagtgggagctcaactatgaggatgcaaaggcataagaatgatataatggactctagggactcagagcagggggaagggtaggagatgggtgagagataaaagcctacatattgggtacggtgtatacttctcaggtgatgggtgcaccaaaatctcggaaatcaccactaaagaacttacccaggtaaccaaaaaccacctgttcccccaaaagtattaaaataaaaaaatttaaaattttgaaaaattaggaaaaggaagtacattttcatgtgttgctctgttttagcacacctggtgcagaggtccctgaggaattttttctttttcttttttcttttttcttcttctttttttttttttttttttttttttcgagaaaaaaatatcacacatttgaggcaggagaatagggtctggaggaagggaacctaaggccatttcacgctgacttccctaggactaaactgaaggcaaaaccctaactttccacccctaagtaacataaggaccagaggctactccctttgcaaacctcccaccttttctgtgtagcagatgggaaattggctgttcccaaccaatcagactgattgcgggcccagtctttgcacagaagtgcaactttgtaacttcaccttagcctctgattggttgctttttgcaaccaatcagatgtttgcacaggagagtgtcctatgtaactctacttcagcctctgattggttgctttccacaaccaatcagaccaattgcaggccaccacttcatttacgtggggtgagcatgaagtggccaatgggaaacctgtagagggtatttggaccccagaagattttctttatctgggcacttgagccgctgctcagcccgctctcacactatggcatgtacttttcattttaaataaatcccttcattccttccttgctttgtttgtgcattttgtccaattctttgatcaagacaccaagaacctgggcaccctccactagtgacacactgataagatcttattatattgggctgataattcacctacacttttaccttctgaatagaaaaggcacttgattagagatgtatatatctaggtgctgggatcaactatgccatttgcaaagtaccttacttcttgagcaagaaggtaaccaaaaggggaatgaataggcaatataatttcttttaaaaatgaattagtaagctcttgtggttacaacaagaggactgttgttttggttctttcacaattttctatagtaaaatttgttagtattaaagtataatgttgatgcctatatttttaaaagatataaaagtagagattttaaaagagaattaaaaaggttttgagggaactgttttagattaagtaagataatgaagagaaacaatgcttaaaatattagaaaaaaagacttatgagaaaagtcagaagtactgaaactgtctagccaaagtagaaacgaaaccaaatgatacctttctcattcatattaattatttgaatgctttggttttgtttttctttattttatattctgttagacgctgtctttcttgtcttcaaccaattcttttctatgtaacattagacagtgtctaataataatacacaaaacaaaaaagttgtaaagaaaccacccacattttctcttcaaaagaaaaaattgtctgagaactctgaatgtctaaagtccttgaataataatgggaaatggaggatggttcatgagtgtttttcagtattagcaaaagactgacaaaagcatgagtttatcaacaggaagtacatatagtcagacttatagactgaaactgttcctaaagctgtgtgtccctgttttagaactatcaccacagtcactgaagccctgggcaattcacagacattgcaaaatcaccacagtccctgaaggccaaagaatgagacacaggagtcttttatcatttcataactcagtgtgcccattcttcctaataggcaggacccagcatctgtggtcctcaatacaaccatttagaaagtcacattgtagtcactccttttgcttgttctggcagggactgaagttggagcacaaaaaatcttgtaaaattcagttcctatatcagggtgtttccccctttttatcatgaagtcacatgtcccatcctgtgtcttaacagtaggtgattattagaagagtagctggcacacagtagatttataataaacaatggaataattagagtgcctagcgcacagtaaatttataataaaaaatatagaataattaatgatgaagaaatgaatggtagatgtagtagaatagaaagatatataggaatcctgagaagtttggcagcacatccaatagaaatgtattgcaaaaagtttatatagtatttacatttcttatagcctcatttaaaaactgagaagaaacaggtgaagtaattttaataatatttatttaactatatgtaaaacaaaaatattatttcttcaacaggtaatcactatatcaattagtattatttattgcattatttattgtaccacctctctaaattccgttgtgaattttacacttccagcaaatctcagcaacacgggatagccactattcaggtgctccaaagccacatgtggctagtggctaccacattacacagcatagctatagaggggtcttagaatattctgactaagtcaggaagggacttttgtcacctccaccaacatcccatgggtcagaacccagttatatggctaaacttaattgcaaaggaaactagaaaatgtaactatagaggaatctttaagaaactattggtcagacaacctaagtgtaatgtgacaggatattatctaaaatcttaatttgaaacaattacatatagttgatataaaatgcataaaatagagaaggatgtactatttttgaagccaggttcaaagtgtatataatgaacactattgaacaaagcaagatttaaaaaaaattgtgaattgaataaaatatgtatagtaaatgtacactctattatgtaaactaaagtatgtttagtataaaaacacccctatactaaaactcctttcaatactccaaagcagtaagaaaaaaaacacaaaatatacatttaccaatcttaatagtctagcttataaactgatatggaattcgttacatgatccctgtttgaacattatgtaagactagcccaggaaatgatatggaaaaaggaatgaaaggtaactttcaacgaagttacatgggagagtgatcaaaagaaaatgtgactttttttccttaactcaacacgtgtacgtgacgcttcaagtatgcaacaatggatctgtgctcaagtcaaatgcacagaccagaaacagaaattggtcagaagacatttcttgttttttcggttttttttttgttttttgtttttgtttttgtttttgtttttgagatggagtctcgctctgtcacccaggctggagtgcagtggcacactcttggctcactgcaacctccgactccctagttcaagcgattctcctgcctcagcctcctgagtagctgggactacaggcacgtgccaccacacccggctaatttttgtatttttagtagaggcggggtttcaccatgttagccaggatggctcaatctcctgacctcgtgatctgcccgcctcagcctcccaaagtgctgagattctgcgttggtcatcaatgtttaaacatgttaaacgtaacatgttacatttaagtaacaatacctacataatcatgtaagtacattcattgccaacttaaaagggagtcttcaaagcagaattgtcagaacttttagcttccctgggccacactgggagaattgtcttgggccacacattaaatacagtaacactaatgatagatgatgagctaaaaaaaataaatctaaaaaatatctcatgatgtttcaagaaagtttacaaatttgtgttgggctgcattcaaagctgtcctgggcctcatgcagcctgtaggctgcgggttggacaagcttgcttcaaagctaacattttttctccaaaattttccctactgctatcgcgatcaatttgtttcctctgaagtgactgattttaactgagatatttttgtttgtttgttttctggttctgcatgtataaatccttcgaatagtgtaaggacactgaatttccagcaacttctgtttcgaaggttcacacttcaaactataacatgttgtgtaattattggaaaagtgtcctaaagcttccattattagcctataaactatagttttggaagagactttgcccaccattttacattactagctgtgagtgcctaacatttagtaagtacccaagaaatatgaatgttagaataaagtcatacatataagaaattctttacattgttcaactactggagaatatgttatatgtagtgattatttttaaaagcattataaaaagcatttcaatttgttcaagcatctcaataagttagttaaaatacacagaaaatgaataaaacaattagaatatatatgtagcatttgtgtgtgtgtgtgtatataaacatatatatgcaaatgtgtgtgtgtgtgtatatatatatataaataggtagagaactttaaagtaattaaaatctgaatgtggttagctcaagtcaggtaaatttgagaaaatctttacaaaagccatttgctcatactactcactctcagattagttgttcatcaggtaaacaatttgctaaataaacatttaaataaaagaaacacattgcataggggaagaaaacataattttacctctaccttgattttttttttttttttttttttttttgacactgggtctcactttgtggcccaggctggagtgtggtaatgcaatcttgtctcactatagcttcaacctcccgggtttgagccatccttccacctcagcctccccggtagcttagctacaggcatgcaccaccatgccgggctaatttattattttttttactttttggagaaatgagggtcttgctatgttgccaaggctggtcttgaatgcttgagctcaagtgatccttcagtctcagcctcccaaagagctgggattacaggtgtgagccaccgcatctagcctctacctttatttcttaactgggactcctataacaaaagagatatcaacaagaaaaaaacaataaagtttactaacatacacacctcatgtatacatgaaagatatataaggaaaaatgaataaatttctctgacaaagaacaatacgttttttgagaagtaacaagacaagggaaaaggaccctgagtctctatgagtggccaatttcaggaaggcaaatatatgggaaactgatggtagataaaggctagttaagaaaatttattatgtagattcctctgatgcagtctccgggctgataaagatctaaagttgtcattggtgatcaaactttgtcctttctgatagagaggagaggatggacacctttgcaaatgtatgtactgttttcaggcaaatagtgggagggcagagaacttatatctgcttcttctgaattgcctttagctcaaaatagtcctgtgtcaaagtggcatattttcatgaacatagagaatggaataatagacattggagacttcaaaaggtgagaggggccgggtgcggtggctcacgcctataaccccagaactttgggaggctgaggcaggcagatcacgaggtcaggagttcgagaccagcctgaccaacatggttaaaccctgtctctactaaaaatacaaaaatcagtcgggcatggtggcgcgtgcctgtaatcccagctattcaggagaccgaggcaggagaattgattgaacccaggaggcggaggttgcagtgagccgagatcgcgccactgcactccagcctgggtgcacagggcgagactccatctcaaaaaaaaaaaaaatggcgggaggctctcatgtaccccagaaatttatacacctacagtgtacccacaaaaattaaaaatacaaaattttttaaaaggtgagattgtggcaggggagtgaggagtgagaaattacctattaggtacaatgtacactattggagtgatggtttcactagaagaccagacatcactactatccaacatatgcatgtaacaaaactacactgtacctcctaaatctataaaaataacaacagaaaaaggcaaatatacatatgctttcttatagattcattaatctgttttatttcagtgaatgaaaacttttgacaatggctaaccttgaaaatatgttattagaacatgtttttctttctccattgtgccctatgagcacaacttgagaaatccagcaataaaatgcaagctagtttttttttttttttgaaacagtcttgctctgtcgcccaaggtggagtgcaatggcactatctcggctcactgcaaccttcacctccagggttcaagcgattctcctgcctcggcctcccaggtagctgggactacaggtgtgtgccaccatgcctggctaattttttatttttggtagaggttttgccatgttggcccggctggtctcgaactcctgacctcaggtgacccgcccgcctctgcctcccaaagtgctgggattacaggcatgagccaccgcggccatcaagcctgctttcttgacatattttgtgacatattttgggatggcatatttcggtctcctacagttggcagggcaatctaaagtactttaatatccttcttcatgatactttcaaaaaatggaatttgatgcctcagaaaacaatactaaaactttcttaaaatattacaatgtgtactatattacttttttaagtaataggacttataaatatttatttttaaaatttgtaaatatttaccatccacctttgattgaacatttttttctcattattttatccaaaaatgtctattgagacctttaaaatttgtattttgtggcaccatctaagacgtgatttatgctccttgtcattatttaatcgtcaaaatgatactttgtctttgcttaaatcagtgtgggtacatcgaacaaggtttgagagctactctgtaggactgagtcattagcctgtaattttacagcggatcaagtactacgttttcattacttggaaagaaaatgaccttgcaattgactcttacatttaacgtttttatctcagctttaccaccattaaatataactgtttgcactgaccacataagaaaccagaaaaatcactgggtcacagtttaatctaattcaatttaaatccgagctagatagctataattggcagtttaccatatcaaaggccagagttaagttacactcaaaattgtgttgatttggaagtaatttgccttaaattttcaagcattgttctgggggtactaaaatgctctttcaagagtttactatatggtacgtaatattttccaagtgttagatgatttatgaagtctacattattatctaaaacaaccaatgttgtaactaccatacaagtctatgaatagaccttatttcacttggcctatctcagggtacaggatcccagccttcttccgtggcaatatgcaggctgttcctcagcaacgatttctagtattgtgtgaaataatcatacttacaatactaacttcttgcttcccaatgccaagaacactcatcttgtttctattgaataaggtgacaggcatgatagaagcagggcagagccaagtcctgacagtaacatttcaagtacagagaaattcatatgagaaaaatggacaatgagggcttgttgtccgtgactttttgttccatgaaaaatatgcctgttagcaaaatcacataactaggaattttagataaagtttctatgtacattatttaaaagagtgctttatacggcatttaagttaaaaagaaagaaaaaacattcacattaaacctaaaagtaactaaaaagtcatagaacagagatgtcatacagatggctagcctttattaagtgtcaagcattgttataatggatttgcatgagttctttaattgcatttatttatcttgttttggtttggtttttgagacaagatctcacttcgtcactcaggttggagtgcagtggagtcattgcggctcattgcagccttgacctccaagccatcctcctacctgaacccccaagtagctgggactacaggtgtcccccaccatgctcagctaatgttcctattttttgtagagatgggggtcccctatgttgcccaggctggtctcagactccatagctcaggtgatctacctgctttagcctctcaaagtgctggcgtgagccacggtgactgaccttatttatttatttttaatgaacaagtaacagttgagtaatttatggtgtacaatgtgatattttaatctatgaatatattacagaaacattcaatcaagctaattaacatatctatcacctcactaacttatgttttgtggtcagaatgttgtctactcttggtgggaatgtaaattagtatggtcattttggaaaataatatggagattcctcaaaaacctaaaaatggaattaccatatgatccaactttcctacttctggatatatatccaaaggtattttaattgatttgtcaaagatatatgtgcactctcagttaattcttaaagcaacgtactgagatagacattattagtatcctcattttacatatgacagaaccaaagcagagaatagttaaataacttgttcaaggctaaacggagaaagaatcaggattctttttaatattttcaagattcccaagttcaaatgattaaacaatctattttttttttttttttaaattgggggcttccaccttttttatatttgttgttagtgggatttaggacatatcatccccaaatatggcaccttggcatttcgggaaacagcggaagtgagaaagtctctgaccttctgccaccattttcctctgaagcagatcagaaaagaattatctggccttgctctgaagtaggccataagacccctcatgtgtcccatacctaaaggaaaggaatgtcacactgggacacagagaagactgaacaaacaggctttgctacattcccccccaccccaactttattaccattagattacacccttttgttctccaatcatacttctgccaggttgtccactcttcatcaaatttagcataaaaatacacaggtctcccctttttctttaggtattcatttctgaatgctcctgtgtcctggtatcatttgtaaaatttatattaaatacatttgtatgcttttctcttgttaacctttcttttgctataggggtctcagctatgaaccttgtgataggcgaggaaatcaattttttctcccctacattgttcacaatccaatttaagagaaaaagtgagcactcttgatgatccagtaccccccaaaacacacagacacatgcagaaataaaacaaaagttttataaaaggtggcatttttagtatatgtagccacactttaataattttatttcattcttttctatttgtttttttttttcctttttttgagatggagtctctgttgctcaggctggagtgcagtggcatgatatcagctcactgcaacctctgcctcctgggttcaagcaattctcctgccacagcctcccaagtagctgggactacaggcacacaccaccatgcctggctaattattgtattttagtagagacggggtttcaccgtgttgcccaggctggtcttgaactcctgaggtcaggcagtccgcccgcctcagcctcccaaagtgctaggattacaggcatgagcgaccgcaccagccttctatttgattttttacattaatggcagttatgacacataaacgggttgtacagctcacaaatgtcttgacctatagcttgaagagcatttgtctaaatgacttgctcaaactacttactcacaaatccgggttctaaagttaggttttttggtttaaaaactgtaggctttttcctcttggttttataattgtgtcagtccaaaaattcttcatttcctaacttttctccatattagctataaatcagaatagttgggaactaaatgggagctttgccaaaggggcaatccccaactacaatgcgttggtctaatattcagtaaaatacattgattttagtaaaattcactgcatattttgcattttactcaaattcaatataaaatagacagtttttttttttttttttttttgagacagagcttggcttttgttgcccaggctggagtgcaatggcgtggtcttggctcactgcaacctctgcctcctgggttcaagcgattgtccttcctcagcctcccaagtagttgggattacaggcacctgccaccatgcccagctaatttttgtattttagtagagacggggtttcaccatgttgaccaggctggtcttgaactcatgacctcaggtgatccgcccccatcggcctcccaaaatactgagattaccccacctggccaacagtctgttcttaaagaaagaaaattaaaataaatataattactagattcagtgtacattttacttttgtgagtatcattcaggaattcttacctcagaaaacctggaaaaggcaagttatttagaaatatgaagaaatcagggtgttttattcttaatgaaagcatgcatcttaatttatctttagaaatgactgggggaagttgattatacaatcaaaatgattaaaattaggcatgtagactttagtgcaagcaaatctgggccactcatttccaggtacatgaggaaatgtactagcacttcttttattactatagctttgaaggcagcgtgttgtcttacttcccattgtttggatttttaaactgataattaaattcatttgcatcactgctgcttggattacaaatacttaaaacaattagttttctgtcagatcacagatctacatcaaatagatgttactttttaaagaataagccctcaccaattagaatgattcaaaagcttttgattgttttctccaaattgttaagtatgcatttgtctttaatgtaaataaatagacttaatggcataaaaagccattctgaattttaaatgaatgacaaaatgtaaatcatgttctggcataatagttttgccaaagtttcaagaaaagaaataggagcattcacaataagcaattgcaagctgtgaaatggcatattaaaacagaggattaagttatttttctagttagtttttggggaaaaaatctccagtcttgcagaaatggctaaataattgcatttggtatggaggctacttttggtcaaaattatgttaataaatatctgagttcctcacattaaagtgaagcaagaatctgtggcatttttttaagtcataaaacatttgtatgttggcttttagatagtaacaagatggcatccatttatctgtatgcttctgcgcatacaaccttatatgacatatgtaccaataaaaaaagtatacatgtattagtaattaaattctagacttgtgctgtccaatttggtagccattagacaatggcaaaaaattattttgaatttaaattagtgaaagtaaaagaaactatgttgttcctccattttgctagctacatttgaagtgctcagtagtcacatggttttagtggccatcgtgttatgtagtgcatgtatagaacattttttgttttttatcaccaccaaaaattctaatggacaatgctggtttagctcttcagtattgcaaactttagcctttaaaagctatttgcaattatttagcgtgtattgtttatgctccaaaatactttcatctcaatgtagaaagaaaacgattgcacttttgaatataagagaaatcaaatccttgatttttttctacataaaaacgtggaatttaaactgaattatttaacaaaaatcaaagtaccttagaaataacctgaaaagaaaaacaaattttagataatatatataattttgaagtagaagaaaactaagataaaacgtactgcatttgtatacttttatagttttctaattattattataattggaaaaaatgaattttaacaaattaggtataattatcactgtggtaagcagtctccagaatggtcccaaattaaggttgtctgattacggaataccatgttcttttaagtccagtaatcccaaccttttctaggataaagcttggtatatggaatcaagatatgtattcttgttattcttctgttaccattactgctgtgggtttcaagaacaggcacatacagtttctccttgtgtgacacaaaccttgtgtgaatactttttggtacgctttcaaactggggcagcactagatgaatgccttttccctaggtatgcctttcagtaaactctccaggtgagaggggtgtagtaagtactgctttacatggatctaagtgacatgatttgatcacagttcaggtggttgtagttatgaaccatttcatgttaaattaaggtttaggggtttattttctaaaataatgctacttacagtgacagcatagcatagaatctacaagttctaaagcaactcaataacttctcttaaatggcccttattattttggattagcattttggatgacaactaactccactccctctcttgaagggaaagagatttggtagaaataattgaatgaatcctggattaatctagaatatgattttatcaatgactgatgaattacactgcactcagttgataacggtgtcttcttctcttagaaatgttgagtttgttcctattattatttcaggagacaaagctttttaaaagagttggtcaactgtagctaggcatgaaagcatggtctctaagaagacacttataattccctaagtatttgattaaaaggaaaacaagtacctcaaaaactcttaagtttatgttataggcaaagaagtccccaaacaatttagtcaacactctgaaataaactcttaagagtggtgattttcacttggcattttggagattccatgtgtggcaatgtgctcctcaatcaaggagttacatttctatgtgcagtaacattgcagttgcacaattaatacaaaaacaaacatatattaatcaatgacaggttttctcattttcatacagagttatgaaacctttaggctaaggaacagaatagtgagaaattagacaactattaataataggattaattagattctggccctacagctaagaaaatggagtgacaatcagaataacaccaaagttttgcaagttgtccaagtgacaaaatacaactaattaatactaataaactaaagtcaaattggactctatttacacaaagtactttttatatacaggcaaaaatttaagtagaaaaattatggcctcccagaactaataccaaaaatttaatggtaagaaaatgaacgtattcatttaatatataaccacatcatttgaaaatattgagctctcattgtaaagacatgacattttctctaaaattaatatattccataaaaatagtttttaaaagagaaaggctttgtcttcattcttttcgtgtgaaggtcaaatatcttagattggaatttaactgcaggaattatgcttctgttcttactttagcaacactaacgatgacattttctgaagtacatattgttaacaccatcatgatgaaagcaaatcatttttctacacttactttgatgctaatcagagcagtcatttaagttgctacatgactctgagacagaaatttcaaaatgaaattgaccaccgattcccagacaaaaccagaatagtggtgtcagatgagaagggttttgcagtgttttgtcacatttcattttgatttttacttttttctctgtttgacatatgttctgaactagagtgccataaagttttatcaccataagtttgaaatgaccacattactcatgagctacagagtcacaagtgagtttttagcttctttcaaagctgtagaaataaaactttatagtaccctaccctggtatatgttgttttatgtgacacattttgttccactttattcttttcttttatttcccttcattattttctttttgaattatagcagaatttgtattaaatttttcctaatacacaacagtttaagctacattttataatatcttatgtatttttttcatacagattatctttgacctgtaatgcccatctcttaaagaaattttagatggtcattataaacaaggttcattgtgaaatatatttctgttgaaacactgattttattacaaaaaggtaatgtttgatttccatgagaaccaaaactattggttgagatatgaaagatgaacatttgcttccctttacacaattgattaaaattcttaatgcatacatagtcacactacacaattagtgtagtacatacatatccgtataacttgagtcttccatgtatatgttatgcaatagaacttctacaaagacatcaatatctcatgctgaaactatccaaactataaaatgattttaggattagcttatcccaaagggaaattgtgagcaatgtggctggcctgacagcctgaagtgatatgctcagagtggatctgataggcagccattcatttcaagctcaggaagcaaacttattattttgtcatacacggtcgtttttccattgaagacattaagacggtaaagaaagtcctcagagtctatggaaaggatcaccagactttcattttatctccagatcttgaactggagcttttgaagattccattttagtgatttctggaaggctgctaatcttaatgaataaagtcagaaacacatgtgtgtggctgattcagattccagaaagaattttggttgctatcatgattatttttaaggcataagtgattaacgctgagatatactgcttttcctatttgtggattaaatttcttctatcggagaagttctaattgaaatgtctccattcaatgtggttgtgcacacacacaagtacacccatgaatgatattttacatatgtaaaaaaagaaaaccgatattaagtaacttctacttttcattatgagacatgctgtgtgtgattttatatatatatatacacatatatatgtatatatgattttcctgtgttttgttaatcattttttatcattttataatttttaccattttcatcattttttattgtgtggctgatatatactagatattactcactcagggaggatacaccctcatctgggcactcttttatacaagttatggcttttgttttaaataattcatctaagtttaatgaaagaaataagtgactgctttatcctagagaagcagcaaagagattttgttcacctgtgcctttagagactacatgacagcctctacaagtagcagggtagaatcaggttgattataaaagccttcatttcatgctaaatggaaaggagaaaagaaagaattttctcctttaattagaatgtggcagtttaatgacagaggcactattgttgtgggttaacatggaatgaaatcaattaaataggactatgtatacttaggtgtctgtaggaatcaccaaaaatgtaactctccaacagtttgctgaatctgcctctgttttgtctggctgctatacttggtatgtgggccatctggctcctggattccagtaaggtttgcatattcacacatcaatcagaagtggtgtagggcctattaggaagcaccagccagttaggtgacatgccaggactgcaaagcactcaagcaggaatgccaagtggggagcttctgctgaagctgacgctgacacgggcattggaggcaccttttgatccgtctagctttactgttgatgtcacagtcctgctagatcaggcatagggatgtcaggtcacgtaaggcctcatttatgtcattggttttgcctggataattcaaatggagcaaaaataaaagtgatcttgatccttaggtcccatgacttttgatagtagaaggatcattgatctgaaattgtcttgcattcctgactagtagacagaaagatatcagaagcaactttgtctattctgtttctagaactatattgtgggtactagtttttcacagtagtactagacatttcagaaacagctaccgaataatctttccaaataaagggaaaggttgtaataaaatgcattcccattccctatgtcttctcaaacagttcactgaaacttaaagggatgagcacactttacaagaaatgcaaataaccttttagttcactgaaataagataaacaacacatgtgtgtatttttaattggaagctctatcattcagttccttgaactaacagctactatacttttcttttgatgtatgcttcacagatatccattgcaagttttagattgtttgcttcaatgtagataagacaaattaactgaaaacttaaaaagcacctagaggattggttattttaatgttttttagacctctggatgctttgatcccatacagaataggatgaaattccactataatggcattgttttaaaatttgaattggccgtaatgtgttgtgtgtgcacacatttatctagctatgaacacaattaatactcactgagagagctctttaaaatgatgacataatttttttctttgaaaagttatttcttacgccctaaatttctaaagtcaccaaaaaaaggtaattttctatatgtaagacttatttatagtaactaaatttctaagtaactgatatctcctaaacagaaatgtctaataacttacttctagatcagctttaacaatggttttgatttatctaacttagtgcagtaatacaaatattagtagtaaaataatacaagtttaactaacttggtataataataggaataatataattgctcatgtttgatgtatgctaactacttggcaccattaagtacatcacatgtattatttcacttttctcattaaaatagcagtgtgatgctattatctccattttacagagagggaaagtgaggcatggagagaagtcgcaatttagaaaagtaataagtataatacttattttaattttaaattattctttgctagaggaaagatgcatgttccttggacatcttctatactttaataatattatttctatgtttctagcaacccccacaatgaaaagcaaatacacgatgcctttgggggacaaagcagttctgtagtcaggcccacacatgaagtgttttacctttataggtttcaacaattaattggaataagctattttttctgttttggcatctgtctacttggcaaggcccccaactgtggtgttggcagctgcatgacagcgactgcctctggtttttccacagcaactggctgaaactcgcctccctgggctgtcctattatgttgaaaattattttctttgactcaaatcagaagagtgtaatagaaattgtgaaaattcctgacatcttcccaaagatgtttttgaaataggttaaggttctccgggagtaaacttggattctaaatatgattttttttttctgacagatgtatgcatgtgttatggtaggtattcagaaatgaatgctctcatttgtaaaataaaataaaataatcccaaactcttaactatagcaatttgtggttttaatcgttttcccttgtaaatggaaacttggtaagttttagagtgcattgtacatgataaaatacatcttatgtctaaaatcttagaaaatattatcttgcattggggaaaacatcataatagtgcatatgtgattcattttatgtaaagtcctaaaattatctaaattaaaatatctatattctatagctgtgcatgtgtgtatgcacacacaagaatatacacatctgcattttatatagatacaagtatattgaaaggatgatacattcttatacagatgtagagcttaggatttctttatcaatataagatagaaactgcgaaagcatgaaaatgaaattaagcatacttcctttattcacttatcacccgttttcagaattagttgccctatgggtaggtaccttttaaattatattgtacatctttcaattaaatatcgggaggttgaaaattaagtgacaattctaatatttctagtggaagacctgaagctgcactattaaaaagctagtaaatggaaggggaaggatatttctttatccatggagttaattacacaagcagtacactatgtaagtgctaggagaaaaggtgatacaaacactacttaaaaggtttccagcgagaagcagctctgaacaaagtagatttaaagtgttacctccttactcctacaaattctaatgggaatcaattatgttccatgagtaataataataattaatatttatggaagtgcttactatatgcttggctctgaaataagggcttcacatattatagcacataactatcctaagtagaagatactatttttacttccctttttatagatagggaaagtaaaacacagaggtgggccgggcacggtggctcactcctacaatcccagcactttgggcggccaaagcgggtggatcacctgaggtcaagagtttgagaccagcctggccaacatgacaaaaccctgtctctactaaaaatacaaaaattagccgggtgtggtggtgggtgcctgtaatcccagctacttgggaggctgaggcaggagaatcgcttgaacctgggaggcggaagttgcagtgagccgagatggcgccattgcgctccagcctggggaacaggaaggaaactccatctcaaataagtaaataaataaatagcacagaggttaaataactctcctacactcacacactccatgtgtctctggtgatcacttggtaccacttcttttcttgcatgtctcacctctcttataaacacattaccaattttaaatgggtgttatgaactatgtgtattaattatggctgagaaccaccatttttaataacatggaattttctttagctggcagggaaggaatgcttccagtttaaaaaaaacggtaaaggacatagctttaaacagaaaagacgctttgaagataagttcatgtccataaagtccattcaaataacttagtaaattgctgataaggtcatatcatgtagcattttttaaaaataagattgctgaaagttcagcttgctctgagtaaacacagagcaagatgattctcaattatatagtgaataaaatcaataagaacatctagtgaaatccaaacagaaaataaaaaaatcaaaattgacttttaaaaaaattgacattttatggagataattgtagatacatatacagttaataagaaataatacggatatcctatgtacactttaccattttttccctaaagttaatattttgcaaaactataatataatatcacagccagaatattgacattactacaattcagcaattttattcagtttctctcggtgttcctatatgtgtgtgtgtgtgtgtgtgtgtgtgtgtgtgtgtgtgtgtgtgtgtatttagttctgtacagtttcatcacatgtgcaggtgtaggggaattggatatcacctccaatcccccttttagttcttagtaggctcttcagttggatctagaaaccaaatcgacatcaggcagaaaacaaaagaaaagaatacaaattgtattacttatacatgtacgtggagatcatcacaagaaagtgaagcctgaagaagtagtcaaagcaagatgcttttaatgatgaatgatgaatttgatgaatttggaaagcaatgacaggataaagagaatctggctagggacagtaaattttctctaggggagtcactaggagatagatagtgggtataaaactagtgaaagataagggttacttcagtaaatatatttattcaggtccattgaagcctccaattctaagtctctggtaataagggctattttctcactctggtcctgtgagggtgcccctcccagaggaatctttatggtttgctgcatgtaggaagagacaggtgagctaactctttctgaaactacaatttctccaaagtttccaactgaaaatagccaacataccaatctggcatatttggggatggaacatcctttactccttcacaggtatctgtggatgagagctgaagcaggcccaccaggaacagagagtgtttccccttactgttggcaattctctggattgcatctacccatcctgtcctagaaagtgtcaggagaacctgatgttgtctcagggaatcctcttagatgtggagagataagcctttctaggctgctttcgactgctggttgtgggtctcgaaatggtgagtctgggtcacttgcttctattaagtgaaaagatgtaagtcactcaacttctgctccagacccagtaaaccaaaactccgtcgtcttcttctgactaccttcagagttatcttgggtttattcctgcattattaccagcatttgttgctgttttagtgggaagaggaagggaaaaatgggtcgaagttatcttacccttaccagaagttcctaaatagactttttcatgagaaagaatatttttaaaaaactgtttatattataaatattcttggtagtttttttgctgttacatattttttaaaaatccatagtgcagatataataaaaactattgcaggtatttaaattaacagaactagttgaattcctacaacgtgtcatgtacagtgctaggttggttgatctgtctgtgcttctgctttacttggaatggatgagcaaaggcttatactaatttgcacttagtattataatgaggtgtgagaaaccaattttcatattcaagtgtctataaaaagtgactatttttcaacagttagctcctttaattataaaatcagtttttattaaaggcagttgatgctttgtgtgttgttgctagggtgacatatattatagaaacatacagtttatctttccagtaagagggaatacagtctctatcttaccgttaatactttaattagagaatgatcgacagaaaaatcttttttctcttcatgagatttgaaaaatgcatatcttctttatctgcatttaatcaaccctgggttcattaggatttgttgtgttggcacctgagaacatcttagaaattattaaataattcattttctgctttttttctttattttttatttccagcagaggcttgtattaaggagattctcttttgacatacccccacatacattcacactaatatatatgcactattttcaactgacatgttttagagttattgagatattaattttataggatactatcacattttatagctcttagtaaatagtatggtatttcaaaacataatttagttatagtaatagaaataatccatcatatttgttgtatttataaaatgtcttcaaaaatatcatataaatgatatctgaaattttgtcctagtcttgcaaatgctaggggattaatattaataaggttgttgtcaatataaatttctagtgagatgctcattaactggaaatccagtgctagagagacatttcagaatacctaaaccttatttagagacaaataaacatactagttaatatggctattgctatgaaccgcataaaattgaaatttgcccgaactcattcagctaagcatgctaacctcggctttggaaaagattgaatggcctatcatcagtcaatcttggtactagagttaaaagaagaggcaagtaatatggacagcacaaggaaaatgacagaaatagcggcttgtgatgataattagcaagaagtttgaataagcaaactctaaagaatattgaaaatgagacaaaaactgttaatgtatatgcaattaaatctttggaccctccttgcttgttgtttcaaatatccaattgtggagagaactacgctagggtaataatattgcccgttttccctgtccctccatgtactccaattaagaaagcagaaatgaaccatctaccctgatttttggaggaggaattgagtaggtatggcttcatgctctttaaattggggttaagcccccatgatataaattatatagggaatgcttcttcttccatttaatgcttactaatggatgtcactaggcaaattattagcaaacatacataataagaagacttaatgctatgttcgctgataacagctttatcattagtaaaggagatattttcatctctattcgtctgactcctatatgtgcggcttaattgattacgaacctaggtggggaatagatttaataattttctcaaactccatctataagtaatatgaagacatgataaatttttaagcagaaaaatgaaatgaaaaatattatgattcggaaaatttgtttccttgtactatgaaggatacttgggagcaggttggagaagagggtgaaggaaccgtttgggggacgcgtcagtaaaactggtggtagagactaggctgaaggatgatagtgggaatggaaaagtgaagacatttgaagggaagaagacattgtgtcggagttctaacgatgttcatttgtgcataaaacttgcatttgtctatcttattgtactttatatattcttcctaataccctgtactccattttactcctttttttttttttttttttttttttgagacagagtctggctctgtcgcccaagcaggagtggtgcagtggcgcgatctcggttcactgcaacctccgcctcctgggttcaagcattcctcgcgcctcagcctcccgagtagctgggattacaggcgcctgctactacaccagcctaatttttctgtttttagtagagacggagtttcaccacgttggccaggctggtctcaaactcctgacctcaagtgatctgcccgcctcggcctcccaaagtgctgggattacaggcgtgaaccacctcgcctggcccctgtaccccattttcaatatggcaaatggaataaatgtttttacaacatttatttgactgttgtttataactcttcaatagctgtccattactgtaaagtttatgccacaacctatagggctctaccttttaacagctatctctttctgattttccacttctctccaacctccctccctaaattacggtgatactgattttcttttaaaatacaggactactatcagcctcctttttcatcttttaggccacaacttaatgtttcttcctcagagaaatttctaaaggacccaaacccacaatagcttctatatgagactacttctcccattatatatcttccaggtatcctgtaatctcctttacaacagccagcagaattgaagtacactatttgtcaaccaaaggtgtgaagcttcttcttactcctggtgtttgtggttttattgactcttctttgttttctttaccagtgagatcccatctacatctttcagtattttcaccagtatcttggtcttttgcttgcttgctttcttgttttctaggttgattataattttattcctctaaacacatgaataccttccgtcattccaatggaattttggacaaaagggaaaaagttataagtgccaatttggttgccatgaaccaaaacagaaaattaaatacaattgcctagataatcaggcccaatttgtattacctagtatgaaaaacactttggtaacaacagtaggtcatgttaaactaattaatttctaggaacattgataaattaaacattggttactctccagagtaactctaagcccagaaaataagtgacttgtacatccatcatctgattcaggttcaaagagagtttctttattttggcaaagccaactttactgaaatgagatgagaagatttctgttgccaatttataatggagattaaaaataagaccccattgtcagagttggagatcatatgttggtaattgtggttttgtacaaaattaagaattgatccctaagaacttgtaaattataaagactttgtttagctcagtcacatttgcctaatctaagatttctgtctaggagaaataattttctagatggagtcaactagtacacctagtttaagtcttctttatgtgagattgtgtttaaaacagtgactcttttggccatagttacaatgagttcttcaagggttgtgtatttgcagactatcagtggaaagcacttgaatggcaatagttggaaattttgaagcaaaggaaataaaattgttacttgaaaccttgtaaaaagatcatacggccgggcgcagtgtctcatgcctgtaatcccagcactttgggaggcccagacaggtggatcatttgaggtcaggagttggagaccaacctggccaacatggtgaaacccgtctctactaaaaatataaaaattagttcagtgtaatggcgcacgcctgtaatcccagctactcaggaggctgaggtgggggaatcacttgagcctgggaggcggaggttgcatcgagccgagattgcaccactgcactccaatctgggtgagagagtgagaccctgtctcaaaaaaaaagataaatttttaaaaatccatgcaaagagcttgctattttgctattttagggagggagcatgagcttcatactcacttggaatttcctgagataaaggcagaaatagaattggaaaatatttaatataaatctgaaaagataaggcatttctcttagaagaagtttctaagcaaggcagctatatagcaaagggtgaggtatatatccctggctgcctcttagcacagggaactggcaccacggggcctacactggcccaagagttcttcaaagataattgtgttcccacaacttttctctgtgtagtaaactcttcctgccctgtagcagtccgcccagttcatgaaaaccatgggatttgacccactgaagaagacttttctcttaaagtttttcctgtttatccaggttttacccagtaaaggtcagctataactggtaatagttttgtcaatgtttccataccttgggacaaagttccttatttgctcggtatttcctctcaagttttacttggcattttgaaatttgaaaaaaattctatgtttttcctggctgtgaaaatgtattttttctttagtatttgatattcaatttataaaataagacttaaagcagctagatatttgcccatcgttatgtttagtggaatgaagaactaatcagctactactagtcttgttccaattaacattctattcctccatttccttcccacactgatatatgtacatatatagatatcagtgtgatatatatatatatcacacatacatatgctcatatatacatatatatcttatataagtctttgacctttctaagggtcaaacaccatgtttttcacaatctaggcaagctgctacaaggaaggaagagtctattatacacagaaaagctgcaggagcacaattatctttgacaatacaccttatattggtattttattttttttctgaaattactctgggttgagtcttatatttagtttctaattgtgaaggaaagccctgtaatgacctggtgatccatcttctttagaaccaagtcggccacagtcctaaaataaacatctgaaggcataggaacatttacagatgaaaatcataatttaatcaattgggtgtattatcttattttctaaatatgtatacattatttctttttttcttttttgtgagatggagtcttgctctgtcactcaggctggagtgcagtggcatgatctcggctcaatgcaacctccgcctcctgggttcaagcgattctcctgtctcaacctcctgagcagctgggactataggggtgtgccaccatgcccggttaatttttgtatttttattgtaacagtggagatggggttttgccacgttggccaggctggtctcaaactcctgacctcaagcgatccgccccaccttggactcccaatgtgttgggattacaggtgtgagccaccacgccaggctaccgtgtttcttttaaaaactttttttcttctatgtaccgtataggttttaaccctgtaagactgaacaccctcttttgtaagacatattttgtaatactcccattactatcctcaaagagaatttaccaaaaatgtaacttacatatatatataaaattctaaaacaattaccttgtaaaaaataaatcaaaggacaataatgaattaaaaataatggatatatttatcatcaataattaattattcaatatgaaaataagaaaggtacatactgctctagataaatgtagtacctgtacctaaaaccacagaagtagacagctcgaaatgctgacgtatgcaggtgagtggtatgaatgattaaaatgccatgaacagcatattttaaagtaatgggatttttctgtatgattaataacatttggtaaagttctgaataaaataagtgcacattttccctttgatttattgtgggatagtttcattcttggaaaatgcagtgcatataaagactttgtatttatatgtaaaattgagctaggttctatatattcacatacttataaacaggctgtcccctacttttcaaaagctgaataggacatgaaacaattactcattttcctggactttcctgcgtgttactggatgtctggcgtccttagagcacctttccatccgttatggggacaatcacagtgctttcacgtttcttaaatgtacccagggtatggtggtgtgcccagttgagaggaactgcaagtgagggttgtatttttttttttttgagacgagtctcgttctattaccaaagctggagtgcagaggcgcgatctcaattcactgcaacctccgcctcccagcttcaagcgattctcctgcctcagcctcccgagtagctgggattacaggcttgcgccaccacacccagctaatttttgtatttttagtagagatggggtttcaccatgttggccagactggtcacaaacttctgacctcaaatgatccacctacctcggcctcccaaagtgctaggattacaagcatgagccaccgtgccaggccagggattgcatttttgcatcgaagtagcagaaactagaaccagaggattttaactttctcatatgatggaatctgaaggaatggagtctaaagcaagaaactggccctgtgatggcatgaaaatcccaggcccctttgatcttcttgctcttttacaccttactatcattctcatgcttgtcaactcttggttgcaagatgatggtttcaacatctccagcctcaagtcttacatttcagagcagaaagatgaaaaaggaagcaagaagaaggaagaggcagcatgtacatcaggaaaacaaaactatcccagaaatccctagctgtcgtcctctcagatgccaaaaggccatgactgggtgccagagatgcttgaaatagagctctttgttcttgcttgacaccttgctacttctaaacaaaatcacgattttgttgttgagagaaaaaggactcctccctatctacttgtcctgagactgcttcagcctctcagcttcctagaccctcatgcagttgatttccaattcttccaggagctggcttactgtctactttttcagggtttcaaaaaaaaaaaaaaaaaaaaaaagcattttttaaagtttaaaaagcaaaatgtggagtgaatattttttggttactatgctttttaaatttttagaatttgtttttactgtgggttggctgttaatagtccatcaagacaactatttctttgctgggtttattggatattgggcaagcaaacaagcaaatagcagtatctgccactggatgtaatcaggaagaaattttcagaaaaaaaaaatgatgcttcaaggtctagataagcagattttccactggttcctgattattctaaataaaatgtttagtcagtggttgtgtaagtttcaaggatgttatagatggctcttgaaaacaataacacattaacctaatattttcagtactcctttttctagcttcatttatcctctcccatgcctgtaaacatgttactttgttaaccaaataaagtcattaatacatgagaccattttgccaaaagtaaacttaaaattaggaggaattggtctttcagaaggcaagaagagaccaagatgaaaggaagtcatttttgtgaaccatatgttttgacccagaagaactatttcacagcctttctcctggtagcaaacaatgagggaaacagtttcttaccatctgcacaataaaacttgttgaatcactcgggaattgggattattgctactgtttgtttgttgttaagccttaaatttaaaaaaagacaggatatataagcagggttggttctaatactgaaataaaacaaaaatgaacaaacccagagaaatctgcttccaaaaagccacagcacaacaaaaagaggtgtaaacatcagaagacctcaagggaaaaatacgtttatttagaaatgggatatcctggggattttgttacagcagctttattaagatattattcacatactgtaaaattcactctctagaagtgtacaattcagtgttttttcagtatgttcacagagctatgcaactatcatcactatctagttgcagaatactttcatcatccccaaaagaaactgtatgcccattagcagtcactccccattcctctctccctctagcctctggcaaccgctactctgtgttgtgtctctatagatctgcctattttggacatttcatataaatggaatcatactatatgtggcctctagtgtctgtaatctttcattttgcataatgtttttaaggtccattcatattgtagaatgtatcagtctttcattccttttatttgctaaataaaatttcattgtatggatataccaaattttgtttgtccatttatcaccagtttacgggtattcgtaaggcttttttttcccactttttgcttccagtagactttttgtatgtcacaaatggccatatgtttctttatcccataatcagaataaaaattatcattcttttagtggacgtgcctttttttaatcaaggcacagaaataaaaaagtgagttgtattttctcattaagaaaacattttggggtgtgcatgttttcagttgtttggaaatatgtagacatattggcagggtatcccacttacttttgctgtgtataaaatcaccctgatacttagcagtttaaaacaattactttattatgccgtggatgctgtgagtaataaattcagataggacacagcagggatgttctgtttatgctctgcaatatctatagcctcatctgtcaagacttgaaagctaagttggactcaatggctggagggtggaattctgaaggcctacatgtgaacttgctatgttgtttggcttcttcctagcatggtggctttacgatactcacacattttctatggtaactcagggttccaagcaaacgctgttctagcaaacaaggtagtagtcatatggtcttttatgaccctgccatggagggcacaaaacattactcttgccatcctctatctgttgaagtagttacaaactcacccagattgaagaggaaaggacatagaccctacctttccatttgccaatgagttttgggaccatattttaaaaccattgtgccataaagggcatgttttatgacaggtgaagctttacgtcttaaaagtatataattacaaatgattaaatttaaaatcacgagaataaaccattgcattcatctaccatcttgccactaaatcagaatcagtaaaacaaggtcaaattgactagaagccacatatagttgacatttggaagaatttgacagaaatatggctcaattggagttactgaatttaaaccaaaacgtttggcaccaagaatcatgggagcccagactaaagaggaaacatacattatatagctcttattatctaatggtgaaaatcctatcaaatctccacaaaggtggtgaactctggtcttccatggcatcctagacaaactttatttacaggcatgtatggtatataaaataggcatagataataaatataataatccagaacaatgataaaacagctactatgtcaaggtaccatcctaacctcacttataatcaggcattaaattctcataagaatcctatgaattagacaccattattatccatatttaacatatggaaagaaactaaagtacggagatgctaatgaacttacccatcgtcccactaataaatgttaaagtcaggatttgaacctagatgctcaggctccaaagcctatgctcaaaactcttgctatgtgaatactggcatattactgaataaaatagccccagttttgtttttaaataaaaaatgttgatcaatttttttcaataaaatattgtttcatcacaataagacctacttattttcctcctgagcagtttttagtgacatcaataacaatttttttaggctgggcacagtggctcatgcctgtaatcccagcactttaggaggccaaggtgggcagatcacttgagctcaggagtttgaggcaagccagggtaacatggcaaaacctcacctctataaaaaaaatacaaaaattaacagagcgtcgtggtgcatgcctgtattcccagctacttgggaggctgaggtaggaggatctcttgagcccgggaggtcaaggctgcagtgagccatcattgcaccatcgcactccagcctgggctacagagcaagaccctatcttaaaaaaaaccaaaaaaattataagcgagtcatacaagttcttcacagcttttcattatggtaaaccttgattaaaagccaaggttataaatgtaatttttgctaagtgcggatgtattgtatctgtagcaaactgtaattcaggcccctgaatgtaacatcctagctctcattccttttgctgtcagatttccctatagataacgtctacatctgctaccttatctactcgcaaatatttatgattttcttccatgaaatttacttttctcccctgaacctgtaagccaaatcaagtgaccttttgtgaatctcaaacctctgtgaattttaggtagatttaatattcttggccaccactttctattcagtcaaattcaagaattctataaagttaaatatatatggatgtgtgcacacatatatatatatgtgtgtgtctctaggtcatgaatcttttaatactatagaacatagaacatagaaaattataagagaaattaaaatatattgtcaatttaaaagcataccgaaaacatgttatatgagaatggaataatacaaattattggtatggggagaagaatcatgaatagtttcatgaggaatgtggcatgtgtaacaggcattaaatatgattaagaactaacactgagtatatacaagttagctgtatcaataaaaatgtaaatcattcagcaataaactataaagttatttttactccataagggtttttttccctgaaattttcggcccaaagtgactgttttttcttcacatgccacttatatagtgtgaccaagtatttagttaaaaaaattattctccagtcaaatcatttgttgtacacttcttggagctgtggcttgcttgtgtttttattgattaaaaaatacagcacaatcttgcacctaataaaaacctaacaaactggctgagtgcggtggctcacgcttgtaatcccagcactttgggaggccaaggcaagcggatgactggaagtcaagagttcaagaccagcctggccaacatggtgaaaccccatctctactaaaaatacaaaaattagcctgacctggtggcaggcatctgtaatcccagctactcaggaggctgaggcaggagaatcacttgaacccgggaggcagaggttgccatgagccgaaattgcgccactgcactccagcctgggcaacaagagtgaacctctgtctcaaaaaggaaaaaacaacaacaataacagaagaaacccagtaaataataggaaaaaagtgaatatagaaaagtaatagaaaatggttgcctttgtgaggttagatgtaaccaaaatattttagcaattgtttagaacaaatagattaaatgaaaaatatttccattaatattttaaactgttaaattctgtctaatttcacatggtagatacacattcattaagacttttcagtgttaagactaaataaagaaaaagaaaattcttcttattgtgccttattcagaatccactgaatttcgttattatttttattatcattatcattatcattatcagtattatttgagatggagtctcgctctgtcacccaggctggagtgcagtggcgccatcttggctcactgcaacctccgcctcccgggttcaagcgattctcctgcctcagcctcctggggagctaggattacaggtgtgcgccaccatgtccagctaatttttgtatttttagtatcttatttttgtgggtacacaatagatatatatatttatggggtacatgagatgttttgatacagacatgcaatgtgaaataatcacatcatggagaatgggatatacacccctcaagcatttatccttcatgttacaagcaatccaattacactcttttagttatttttaaatttacaattaagttattattgactatacttaccctgttgtgctatcaaataggtcttattctttagcaaagcatatttgtaaagagtttggagtttctctttgctttacacactgtaaaaaaaaatgtcaaacaaggttatccaaagagtagtaggagaatgagcattgagatcataagtgtctcatctgatcaaagttattcaagaatgaatgcattttggaggcaagagttgaggaccatcgccatcattgactatggagtaacacaagcccagactcttgagattaatttggcattatctttcaaaattaaaagtataattacatatttacatagcaattctacttcaaggagtttgcccttcatttatgttttcacatgagtaagggtttagatggacatgggttttctttgtagctaggtaatagtaaaataggtaatctaaatggacatagcttggtggtagtccatgcctgtgccctttatactacagttttaaacaagagatgaatttatataaacagatgttgaaatgtgatcgttatgtagtattaattgcacaaaagtagaacatatatatgtgcatatgtatgcatacatacatgtacatacatatgtgcatatgtgttctagtttattatatatatgtcaaattgttctatttgtatgaaaacactataaatacatacataataaataaacaaatatgcgtttgtgccaaaaagcacagaacatttctgtttagtctcataccactcattttatagctttatagataggaagaaggtagactttgatggtacttgaatttttatctatgtatctgggcaagtattttatctatgtatgtggtagcatattttatctatgtatgtggtacatacatgttttatgtatatgtatgtatacatgcatatatgtatgtataaaatacatacatattttatctatgtatgtggtagcacgtgagagaatttttgttaatttatatgttatttcacttcaaaaattgataaactgtgtgtgtgtacatatatgggtggtggctatatacatatagatattatatttctgggtggtttataaagagcagaaatgtgttgctcctagttctagaggctggtgagtccaaaagtcaccagcatgttaggtgtcttgtgagcccgcttcctcagtgacgttcatcttgttgatgattcctcacatggtggaggggaaagggagcgttctaggttctttttttttttttttttttttttttttttgagacagaatctcattctgtctcccaggctggagggcagtggcacgatcttggctcactgcaacctctgcctccgggtttcaagcaattctctgcctcagcctcccaagtagctgggattataggcacccaccaccacgcctggctaattttttgtatttttagtagaggtggggtttcaccattttggccaggctggtcttgaactcctgacctcgtgatccacccaccctggcctcccaaagtgctgggattacaggtgtgagccaccgcgcctggcctgtaggttctcttttacgaggcaactaattccaataatgagagctccatcctcgtgacctaatcacctcccaaaaagccccaaacccatctcctaatactatcactttgggagttaggatttcaacatatgaattttgggtggacacaaacattcattcaataacagtgactatactatcctatgttaacattttactattttcaaagcttttgttcactttgtatatatgcatttatttatctttgtagcaaatgaaggataaaaatatcttttggagtattatcttgacatactctccagctgctagggatgacctgtcagtattgaccccttgggctgaagcaattcgatcctctcaaaactcaaattgaagtgagaactatctcttctcctttatttcctttcaccagaaatagctatttcatgttttaaaacaactggaaggtaactgaaaactttcagtggtgttaaatcactgtcagaaaaaaaaaaaaaatctgtttgaaagttggaaacagctcaagtaaagccatttaatctgaccagcataagcagattctgaagaaaatggtgaagaatatcattagcagcaatgcacacagtcatttattcattcaacagatgaacatttgatgaacacttactggttcttggggactatactccatgcctaaaatacaaagatgaacgaagacccaattcttgctctcaagaaaatgatagtctgttaagaagaatttactggaagatagataagtataatactgaaaagtgtgaagaatgaaacaataagatgtgcaaagtacagtgctgtcacaaaagagagagaaataaaagctaactggacaggtcagaagaggcttcacatggcactgtcttgaagaatgcatagaaatattctacaaccagcaacttccaattcagttgaactatctccatgcttcctgttcaaccgagattacattttcaatcttgtttctaaaggaaggaaaaaaagatgagtcatttggtacaaaaaagcaagaacagctatagtctacactataagataaatgtagggtactctttaaatctagtggacgctgtccgtaccctttcagcgctcccattttgtctcatcatctaattgcgtgcacctgaagactttctctgatgggtttgccactgcggggaaggctagaagtgctggaatattgaagacccaagcagcattcttcaggttaataatagatgagaattggatgataaaaactctaaactttttacactcaaataggatgcatgaggcatgtctatttcatttgctagaagtctccagtggcattaagtcccagtcatccatagtcataacttgctcattaatgtactctgtgtgttcctttcttctctatctcacttctctacttcctgttgatgctttctgtgatctccatcacagatcttcctgtttctcacttcctgttgatgctttctgtgatctccatcataatcagctacatggactcaaatttgtcatttaagtctgatcttggggaatccaattttagacattgagcaatggactggctgggagggatgaaagaggagacaaaggggctcctatgttcctggttcaggaaacggatgaataacatcaccagttagtgaataggcactgcctttcagtacctacgggagtgctttgttcagtacatatcctgcccagccaagcactgaagaattcatgaattttattgtaacctaaactgcctgtggcattatgaacctgtgtaatcatgggtagtgttggctttataccaggattttgctagcttgttagcatctccatgtgcatttgcaagaccttggccactcttcagtgttttctactccaatttgcatcattgtccctgcaggatgtttatcactcagacattctgaaatttggactgatgcttgacttagctctgtgattggatgcttctcccagaacctttctcacctctatcagctacgctaatgataatctagacagaggtttccctccacgggtgctgcagctcaaactgtgccctagaccactgtcagtcaacctcttcaatgccactgtttggtgctttgcttggttctttcagtctgcatgaagtcgcagctactcaacttacatccatgaagcagcaaggggaaacttcccattctcagtgttttaatctgttctctgttataaaggaggcatagtagagttgctggaccccaaagagtgacttgtaataaaataattctttaaaatgtatacatagatcttgtatcccagggcacacatttgacatgaaaatggctgttttggttgtaagtgcaggtaacagccatcaaggtgtacttgggactcctcctccactccaaatcttaggcctcattattatttagtttatcctgtctgtatctgcaagatgatttttacgtgagaacactagacttaccccttgacactgtgctttttgcagctcctcatatttgatgggcatgaaagctaatatgttgtctaattatggagagttttaagttattaattttatttttatcaggagatccttaaccccctatacaaattagatctaaatagatactaaaagatgaagttaatatttaactcctttacccaccagatgtagctgaatctttgcattggacaagtgagaatcctacttactctgaatcttagatactttgctttgagtatgattcaatgtcactgttgctacagaagtataaatgatggttatttatgcttgcatgttttccagaaagttaaagactattttattatattggctttctgattacttgactgaagttcataaactaacaaataaaaatctaaaaacactctctggggacctagacaaactataatgattaaagcatatagttactttgaagccaagatgaggtaaaggggataacttaagacatatttattcttaggctgacatatcttgtcattattatgttacaggtgcacatggaccatttattttttctcttatgaagaatttcaaacatatacaaaataaaaaagtaacataatgcataccatacactgctcattagctctaaccattattatcattaccatctggtttcctctctacctacccacttcctattctctgttttgaggcaaatccccgaaagtatatcacttctactctaaacatttcagactgtattcccaagtaacccccccaccccacttcttttttttttttttttgagacagagtctcgctctgtcacccaggctggagtgcagtggcacgatcttggctcactgcaacctccgcctcccaggttcaaatgattctcctgcctcagcctcccgagtagctgctactacaggcatgcgccaccacacccggataatttttttgtatttttagtacagatgggatttcaccatgttggtcaggctggtcttgaactcctgacctcaaatgatccgcccaccttggcccctcaaagtgctgagattacaggcgtgagccaccgcacccagccccggaaaatatttgcttaatatcatcaaatacattttatatttcccaaattatcctataggactcctctcttctctctgttgtctctgtttcctccacaccctacatcctcctcctccctcatcctcgttctcactctcccttttcatttttgaagaaacaggaccttttgtctaggtttgttgattacatccacatgatattgtttaatgtgtttcaccagctcctgtggtgctgacaaattagcagctaagtctagagagctacttgtagtcagtttgattttgttctttttttactcaagatgattgtatagaaagtgttgtgtactttcaacaaaaggtatataacgtttgatattggcagccattgatgatcattgttttgattgattatttcattatgagttgcaaaacaatgatatactgtttttacttcttcatttgttaggaggagcagttctataaagagaactttttgttttgttttgattttttgtttttgagacagagtcttgctctgtcacccaggctggagtgcagtggcataatctcggctcactgcaacctctgcctcccaggttcaagcaattctcctgcctcagcctccctagtagctgggattacaggcgcacgccaccacgcccggctaatttttgtatttttagtagagatgggattctgccatgttggccaggctggtctcaaactcctgacctcaggtgatccacccacctttgctttccaaagtgctgggattacaggtgtgagtcactgagcccggcttataaagagaactctgcatttctatttggttgcctcatagtataattgatacaaagcaaagcagagtaaatgcttcagtttttcccccaaaagaacaattttcaaaataatgaattgcttctctagtctcttccaaaagttgccagtgaattttttttttttttttttttgagatggagtcttgctctgtcaccaggctggagtgcagcagcgtgatcttggctcacttgcaacctccacctctcaggttcaagggattctcctgcctcatcctcccgaatagctgggactacagacgcgcaccaccacgcccagctaatttttgtatttttagtagagacggggtttcaccatgatgttggccaggacggtctcgatctcttgacctcgtgatctgcccacctcagcctcccaaagtgctgggattacaggcgtgagccaccgcacccgaccaccagtgaatattttatttatttattatcatccagttgtttgttttggcatcactgcgaatgcatgaatttaaatatatttaaatgtaactgaggctctccaccttctgtattatgatctttattgtcctcatatttttcatctttatgcgatggaagcctcctttacattgacctcctgagtcctttctgtatgacctttatacactttggttgaccccaacttctcttgtagatcaccagtgggcattcctgaggtgtgggtataacatttatctctggattatttattcattcagaaactttacttagtaattaacatttactaggcgttaacaaggaagcagtaaagcagcaaacatgctcatttcaatatttggattaatacaatcaatcaaaacagtagttattgacaacttacttattgtgtggttagcacactcaaaatttatgcagagaaaaaagatgagagattagacctcctccttactgtaacacattttcaatctgaccagagattttgcttctgcaaatttggatgcctagcattggcatcatcaagactttcatagctatggaaccatcagatataaaatacaccttagtatgcaacctcaacgtgttcttcctcttgcaattgaggttatattaatttattaagttcattttgggataaagaagacagaatcatagttctttcagcctgttattataacactttattatcctttacctccttccaatttttgtgtctaataattcgtgtgcatgtgaactgtcttcacttttgagttttattatgaaactcaaactacaatacacatgtatgcataaatttctgtatatgtggcatgcgtgtatatgtgtgtatgtatgtgaatatataaatttcgttgaatagagtggtatgattgtctttggcctccttaattatatatattagcatatgttctagggctcctgacgcttcttgcaggcagaaggcatttccagaggttgtgtagatccatgaaggacagttatcgggtcacatctcacatcatcactgtttctttcttgcccctgtcttacactagtacccttcagggtattgtatgaaagcttcattggttcaaattcattttgtcctctagtgctactttctatgctgacaaaagcatagtgaaactgatgccctggcttgtactgcagtaatattgcctccaagcatatcaagtacaggaagttaaatcctatatattattaagccagatcagtaacatgtacccaacaatgtggtgagacatattttgttttaataaaacgatgatgttacaaattcttcaaccttcccatatgtgtggaggtgtgtgtgaatgtctgtattaatctaccccatgtctcctggatagagtttttctacaaagaaccaagctcagcttcccctagtgttaagacattttgcttcatgcttggtatagtgtagtgctactcaaacctgagtaataaacaggccagtttaaagaaataaaaagccctatgctcaaccaatgctgattaaaattatttttattaaaatttacctatagaagcacgaatataaaacaaagggcacactctttatggtgaaagggcatatagatctacaacaacaaatcatattttcaaatcaaataaaacagaagtacagaaaagcaatagaactcaaaagcataaccttaatgtgtctgccaatgttgtcttggatacattaaatggccttttataatgtgaatatagtactagctgcaatggtgcaagttattgtatttttagcatttttcaatatatgttgtgaagactattttactgcttttctctattcagatctttgcaaaaaaactcatgtatacactataatcatgttttttgccattttgtagtcctatgcttttgtgtcatcagccttccccagctagaaaagtataatattctattattgtatgctgttgtcattttcccacaatcaaaagtacaaattattaaggaaactgaagtttcggtctaaaatgtgttgttcagatgaaattatccataagaaattaaagttgtgttcttataactggaaaaagaacttaacgcaagtataatatgtgcaaaactgggatgacttagttcttgctatcattaagaggggacaaatggcaacgagacgagctttaacagctgagaaaatcttatgcctagatgtacataggcctggaaattacatagcagtaaaactgtaccttcaaatagctcaaaagcagctcataataactgcttgagattatctcagtgataaagtcagtataacatagtgttttttattttaaaaaggaaaaatgattactttctttacagtatgctaattaaaatatacaggtgattgaaaaaactattaataaaaatcagtaattttgttgagtgggattatgaatattaattatttaattaaaatttccttcaatagttaacaaagatttattgagtttctgagtcaagcattcttctaaaggctctgccttattagaatttttaaatgtatttgcaatgagtgtatattaaatgtaaaatgtatgattcaggtttaaaaaaaaatagcagtgagagtaattgaatgctgaggttaaatagaatgggtgaatcaaccataccataaaaaacttctaagtggatattatattccaggcactctttcctacttcagctgttgataaaatcaaatatttccttagagacccttgactaatgcaggaaataaatgaatacttgcctatatagacaaaataataacaacaaaagccagaaaccaagccataccaaaacgaaacaaaaacagaaaaactgtgatgacataacttatctttcaataggattttctcagaatgggaggcaatatatattttatgcttccatggtctgtagattccaacatttgtataattaacatatacaattttacaagggaaaaatactattcaacaaatacgtaaatacgttcaatgtaatcatgcagtacttcgtttaaattgaccttttttttttttttttttttttacaaatggtgcaataaaataatcatgtttaccttcttcacatgttcattgatgttggcgtgcacggttttatctatatgatgtgaccttttgagaccacatgacattcacaaactgaaactaaaccaactaaataaccagttatccaaagataagcaaaagtggacgtcagtttaattagtaaggggagattttaatcagtaatacactattataatagagaagagttcagcatgaactgaactgaactttgatttgtgtagaggtgactgggagttttaaagggagaatgagagaatgagtttgagtggtggctcattaaagtcagggaagtaacaaattacaaaaagtggaaaggtgggattgttccctgggaaacctctacgtttgctaaatggcacttaaggttaggctcctgccttctcactgtcttcgggttttgactggaacaaagggtaaattattttggcagctttgagttttctcagaaatgcaccttaagtggggctagagttatcctagagaggtggctttgacctgttagaagctatgttagtgttttttgttcaggtctgtgcaggccaaggttatggcctagctgagaagagggctcagaggagcctagctaaagtttggtcaaggggagcgtcttggtggagcctcactcctgttcaagtaaagaagacacattattcatccttctgaacagtgtaagtccatttgtcattcgattgccttttgtttactaaggactagctaaatcatcggttgagacttgctagtagagcatagttgctggatgatgcacgtgatcaggcatttaatgagaggcacctctatggaaacaaacataaaaacaaaaacttgttggagaagaatataaatcctatttgttgagtctagagggcaggcagttaagaagttttctagacattgaattctaagcatcttcagatggtagagtggtaatctgatggattttctggtttatggtttgaatgtggtgatggcataaacattaatttcacagtcatagttatttcctggaacagaacacggatgatgctggagttccagtggactttctgaatggctcttgtagcaggagctccaggcatgaaggttgcctatacgtgatttgttgtggtggtaagtcttttgaagtttatatcaagttcttgggcttcagtgtgcaaggctttttcaaatcctgggggagaaagacagctacaagacaaccttgtaggttgtcccagtagaatcagtaggttgtaggagtcccagtaaggatttgggcagtcagattttaattctcagtgatgtcaagtcaagagggaaggcaaaaaattataaacatcaatttggagagatgtagcccgatattgaaggaaaactaaacaattgagtatttagtaagagtggcaaaatgggtgagatggcagaattcagtttagtttacaggtaaatgataaaatcctcaagacaatgaacaaaattggaatctgataacccacagtggtgtgttttacataaaacacaacaaaaccggaattggatgagaagagtccctggatctagggtcatcagaatgtagctattaagagttggattctgaagccaaattcaaattaggtgccttgtactttgcgcactgaatgctctcaggcaaattatttaccttctttgtgcctcagtctattcatttacaaaaggaatcttaagagtatatatctcataggattgttttgaaaattaatgagtacgttacattcaactgtgtctgccacattgctgtgaagttattaccttcctaatatacttacaaacttcataattaagaaaaaataaaaattcataaaatgaacatatttgtaataacttattataaatattgtatagttcattaaatgtattacctttagacatattaaaaataacacacccctcatccccccccaaaaaattcctgtatgcctgttttaaagcagttctgcatgttaaagctgcatttatgatatctaagaagtgttttttctcctaaatagcaggttggtaataatgtatattgcaatcgtaataatgtaagttctggttacaatagtttatctgggtaacatgtagaagttaagtgaatgaggtaataaattaaccaataagattacctttctggtagggaggaaaaacacttctgggttgaattaatattttgtacacatatgaaaggaagaagaaaaataagaaataccatttgcaaagctgactttaataaattttaattgaatggataaacattttagttaaaggtagtaatcttaacttgagattacttgagataaaaatatatattttcttaagagacatgattgttagataacttagagatataataagtggaagggttttccattaaggtaactgatagtccttaggtaaattaaataatgggaggaacttgtgttaggaaatcaacatccgagttacagttaaattggtgggagtctttccagtgcctgaagatacagagattttcaatagaaataaggtttttctgagaaattaagtgaaataaaatgtgcaatagtgattgataagcactgtttattgaagaaacgatttatctttattcttgccctttgctttttaaaacttttattgcattttcttctatttttaatacactttgttattgaagcataacataaccatataccataaacacagatagctaccactcagatcaccacttggatcaagaattaggaacgaacatatttgattttaactgcagtctcttctctcttacgctgaaaatctatgtttctaatgacattagtataattgcttatatggtaattaccttactatatacatataatggttccaaaataacagttcttgaattatttttataaaacaaaattaacacaaagatttatagtgatttctgcatttattttattattatatgtttacagacattggctaatgcttctgatgatcaggcttctctcgattaactgaagatagccttactctgcagctgtgtatttcttattccatctggagcctatgccatcagacattatgtctgccatattttttcttctgtggaaaatcagttttctttctgaagtgcttatttttacctttggctgctgatgtagatctttcatttgttcttcatcttaggctgtgccctggctctaaaaagtgttctcactgtctctttgctttcatttttttcctttcctatccctacgcccttaaatcacaatatctgtcagagttccagaagaaagaataaatactcaaaggagtcatgactattataatagttgatagtgtttactttggcctagttgtttctagatttgtctcaagaagcaaacaaaccaaggattatatatataccatcttgaccacaaaccaagcctcagattcctctatacatatgtcttaagttaccaatacatgttaactgttataatatttctttgactatatgtatacaccatgtagatgtagactatgtatactttgcatcctgctgtttatcacatgcctggcacatattaggcactgaaatagttgcttaatacatcaaaataaaattgaatagggaaaatataatttcttaagttagcattcccctctctccacccaaaagtattaaataaaaaaacaagagtttacgatgactttaacattatgatagagatacaagaaaaacaaataagtatagtaattgaaatggtgcccagaacaccctctttgttgacactaaaagtaagttcatcagaccaaatctgtactgttcagctctggggaacataatttaaatgagacactgaaaaactggagcctgtctagaaagcaacttataattttagggacgtattagctgttttcaaatattcagctaatcagtggaaatgcaatgaagcatattcttattatgatgagaagaaaggaaagagagccctttgtccactaaatatttaaacaaacaaactttgtaacagtgagagatggccaaaaatataaaaagcttaatctggaagtagtgagttgtttttcactggggtgtgggcaggggcttcatgtctatttaaggaatgctgtgttcccatggaaaaccagcacaagacaaggatgccctctcttaccattcctatttaacatagtattagaagtcctgaccagggaaatcaggcaagagaaagaaataaagcgcctccaactaggaagagaggaagtcaaactatctctgtttgcagacaacatgatgctatatctagaaaaccccatggtctcagcccaaaagcttcttgtgctgataaacaacttcagcaaagtctcaggatacaaaaccaatgtgccaaaatcactagcattcctatacaccaacaacagagagaaatctgttccattgcatctgttgcatgcagtgcaacagggagaaatcagtaatgcaatcacattcacaactgccatagaaagaataaaatacctaggaatacagctaactagaggggtgaaagatctctacgtggagaactaccaaacactcctcaaagaaatcagagatgacagaaacaaatggaaaaacattccatgttcatggataggaagaatcaatatcattaaaatggccacactgctcaacgcaatttattagattcaatgctattcctattaaactaccattgagattcttcagagaactagaagaaactattttaaagttcatatggaaccaataaaagagcccaagtagccaaggcaatcctaagcaatttattagagtcaatgctattcctattaaactaccattgagattcttcagagaactagaagaaactatttcaaagttcacatggaaccaaaaaaaagagcccaagtagccaaggcaatactaagcaaaaagagaaaagctggatgcatcacattacctgacttcaaactatactacagggctacagtggccaaaacagcatgatactggtacaagaacagacacatggatcaatggaacaaaacagagaaccaagaaataagactgcacacctagcaaccatctgatcttcaacaaagctgacaaaaacaagcaatggggaaaggactacctattcaataagtggtgctgggataactggctagccacatgcagaagatagaaactggaccccttccttacaccatgtacaaagattaactcaagatagattaaagacttaaatataaaacctcaaactataaaaaccctggaagacaacccgggcaataccatttaggacataggaacagacaaaggtttcatgacaaagatgccaaaagcaattgcaacaaaagcaaaaattgaaaaatggcatctaattaaactaaatagtttctgcacagcaaaggaaactatcaacagagtgagcagacaaactacagaatggaagaaaatgtttgcaaactatgcatccgacaaaggtctaaaatccagcatttataaggaacttaaacaaatctatgagaaaaaaaaaccctactaaaaaagtgggcaaagggcatgaacagacacttctcaaaagaagacatacatgcggccaacaagcatatgaaaaaagctcaacatcactaatcattagagaaatgcaaatcaaaaccacaatgaaataccatctcacaccagtcaggacggctattaataaaaagtcaaaaaatagtagatgctagcacggttgtggggaaaaaggagcacgtatacattgttggtgggactgtacattagttcaaccattgtggaagacagtgtggcaattcctcaaagacctacagacagaaataccatcaacccagcaatatcattactgcatttatacccaaaggaatataaatcgttctattacaaaggcacatgcacacgtatgttcattgcagcactattcacaatagcaaagacgtggaatcaacctaaatgcccaccaatgatagactggataaagcaaatgtggtacatatacaccatggtatactgcgtagccataagaaagaatgagaccatgtactttgcaggaacatggatggagttggaggccattatccttagcaaactaatacagtaacagaaaatcaaatactgtgtcttctcacttgcaggtgggagctaaatgatgaaaacacatggacacttagaggggaataacatacattgggacctgttggagggtggagggtgggaggagggagaggattaaaaaaaaataactgatggttagtaggcttatatctggatgacaaaataatctgtacaacaaatccccatgacataagtttacctatataacacacatgcacatgtacccctgaacttaaaagttaaaaacaaagaaaagctgtggataggtttggtggacaaactaggaactggagaatatatgggaattttacaatagtctcactggagccttagtgggttttagtagtgtttcaagggccatgtgtagggtgagaagacagtggatgcccaccaccaccactaccaccatcagcattcctttagctgaatagctcactcttcatctgtttcatattgggcttctgggtcacattctatttaaagaaagagtttccactcgactctgaggtccttgaatccaaagtatctctcataggtccttggagcaatcgtattggaatttttaaaatgttgattgaatggcttgaggtgaaaggaacctgttgcacagaactagttctctgttatgagtccacaaaggtcttaaattcgataaacattgtttttactagtaagtgtcttagtatcttaaaattatagtaagcttgattcttttctatcatgttggcacagttcagttagcaaataataaaatgaaacaatgatgatatgtaggtagacatattaacatgcctttgtatggagcaaacaataagaagcagatgggacagtctgaggaacgcattaacaagagtttctgaagccaactgctgctgcacctgttaacctggaaggagattaatgcagtagaacagctactgtctttccatatttcttaccacaaaaagatgttttattacattcattgtaacctcttggtaacacattcagaatacaagcttcttcctagtttccgcacatgtctttctcatgatagcatactgtctttgaaaattccatctgctttgatgatttgggctattctatcaaggcaatataaaattgtttttcttaaactttattacaggtcattgagtttcatgatctatagtgaatatttctgtattgatttgttggtatttttattttctcttctcaagctccttgtaagtggggactagcaatgtattttttaattttccgaactatttaaaatctttgatgccaatgattcaacttaaattctggttatatacaccaatgataatattttgtatctagccgatatttaatatttatcatttttttaaagaatcattcactttcatcactatcatagagatgggacaaaaaatataaagactattttacgtatgtatgacttgcttggtaattatttgctgaatgaatgaaaaatacaaaaattgatagttttgctcttacccatcttgtatatctcttccagtgctcattttgcattatgtattagttcatctttgcctttattaagagtagaaaacgccatttcatcttttacatataaaaatgagtctggtctgatacagttactcacatcttcgcttaaatttcttttcttcttcttttttttttttttttttggtggagtcttgctctgtcacccaggctggagtgcagtgacgcgatctctgctcactacaacctccatctcctgggttcaagtgattctcctgcctcagcctcccgagtagctgggattacaggcatgcaccaagccacccaactattttttgtatttttagtagagacggggcttcaccatgttggccaggctggtcttgaactcctgacctcaagtgatctgcccgtcttggccttccaaaatgctgtgattacaggtgtgagccaccgcacccagcccagtgaaatttcaatttgaatttggaagctctactaaggtagtaatgtgaactttcaatattattagaaagctcatcaatctgaaatttaacataaggtaaagaaataaaaagcattaagaccttacttcatatgagagctagaatccatgacctgaaaaataaagtagataaattcacttataaaactataatttaaactcttaacttgtaaatttggggaaattagtggtgaatgggtttctaatatatggaacatgaagcagtaggaaatatgttatgagttgtgacagatattccacctcccacgagactgtgatttttagaatcgacgtgttataaaattgatctgaactttgtccctgatgctggaaaagtggcaacctgtgactgctctaaagtaagctaaaggagctgaacaaggctgggcacagtggctcaggcctgtaatcccagcactttgggaagcagaggcgggcggatcatgaggtcaggagttcaagaccagcctgaccaacgcggtgaaatcccatctgtactaaaaatacaaaaattagccgggtgcagtggtacatgcttgtaatcccagctactcggggagctgaggcgggagaatcgcttgaacccaggaggcagaggttgcagtgaaccgcgattgtgccactgcactccagcctgggcgacagagtgagactgagtctcaaaaaaaaaaaacaaacaaaaaaagaagctgaacaaatgctggcattcatacatggtttgagaaatagccctttttcatttaagggaaagacttactgagatccagattgagaaaacaccccatcaacaataaagtggctcaggaaaatgttttatactagcacatcttcaagtttctacttaaggctattctacatgaatatttaaaaagaggagatgtcaaatataaaagcacaagaggccccgagggcttagtatctttatttgcgttaaggtttctcataaataattctatttggggatataggctctggtatatatgtaataaatgtgagtctttttaatatcagagttacccttaggatagtaagtgtatttatttcaaagaaatataaaaataaaatgaataaaatatttcaggtacctcagatcattgcaaattagtcctcaagtctctttcagtttttcttggattatatgaataatgctttgggatagaggaaactcaccaaagtatatttctgaggactgggggtgggaaaggtttcagaaaggagaaacccatgggaagaatttttctactgactgtcaagtaattcatctcaacagaagaaaagctgattttcgatcagtttaaggtaatagaatatgtcagaattcctggggttttctttgttcaatagcccacttaacctgctgcagaacaccctaggaataacaaatgaatcataaggtagagggacattccagcacacttgttttcttcaaatattgatattttccccttaaaattatatgtctagaaaagcttttgctcggacagagtctgtagggccagaaatataaataactgtcaaatataaagctgaatcgcctccacaagattttaggaacttctgggctggggaaatgtggcctgaaggaaggctgctggtttggccactctctgtattccatcagaaaaaatggtggggtataatcagaagttgaaatgctcacagtagttttaccccatggcttgtcagctgaatattgcgacaatataggaattcttcatcgcagaaggaatgagcctccctggactgatgattttctcagtttatggtgtgtgtgacgtttttgtaaagtggcaaatagttgggggcatgagctagaaggtaactttaggaggttcaaccaaccaagtaccacctgcgaattggacaaaattcaatggacaaaagaaaacttaattgtcagcttactcccgccttttactcccgggacctagcttatagcacatggttcataaaagactctataaatgattactgaatgaatgaataagtgaaagtgcacaaatgaatgtatctctgagattttaagacacttttgtgttcatgcgtcttgcctacctgtctccggtccttctgaattcataaaaagaagaaagttcattttttctggaatgactgatcttaggaaataggaataagtaattctgatgggtagaaagtgcagtgtatgaagattcagaagggtaaggccaattaatttaaacactctgagtctatgttctaacctgtaaagaaggctgataatatttgccttctctgctatggtgttcccgaattgtgctttccaagaaatataccatcacacaatatatggccgtggtgaatacagtctccaatgtccttctccccctgcaatgtgccaacagagtgatctccctaagcatacagggtggtgcagtgtaaaggcacactggtttctgtttgaattccagctttgctacttactacctccataatgtgtagcaagatacttcatcactcacctgtaaaatgatgataaaatgatacttatttctatgagaattaaatagctgatacaagtaaagagcttaaaacagtatttggcctgttttaagtgctcaatagatcctagatgttgtcattgctgttactactgctgctgctgctactactactactactacatatttgtttttggaccctacttaatcccataggttgccacaactactgtctacataatgaaatctaacccccaagtataggatactggtttctaaaaatctagttcatggctatagttctagcttcattcaccaccgttctactagcaataccagtccatctgtatttcctccaatagaccactctatttttttttttttttttgcctctgcacctttacactggatgtttattttgcctttagtcacatatccacaaagagatgttctgggctccatatgatggagttgcatacagtgctgagcttttctttcagggacatattcagaaaggatgagtttttgattgttgtcaaatttgctgttatgctgattttttttagaactgtttgggcgactaatacaaattcatccaaagcttgttaagaatacattgtaatcatcagtatttttaaaaagcgattcttcattctttaccattgtgtttcccatcccaaggatttcttcagattaaaatattaaatgggacaggcaacactttgaatgtaaaggagaaatgggaaacactaacacaatggtggcatgataggggatgaaacacagaaagttggaaccaaaggggagcaccatcgttcatatttatgtgtaaggaaaagaacagaatgtccttgggtagtttactatttcttaataattctcctcacttttaggcaagcttgccagtttttttcagtggggatcacaaatgcctatctgtctgtctgtctgtctgtctgtctatctatctatctatctatctatctatctatctatctatctatctatctacctacctacctacctatctaatctatctatcatctaatatattatgtgtgcgtgtgtgtgtgtgtgtgtgtgtgtgtgtgtgtgtgtgtgtatgtaacgatttaattgaagcaatggtaagacattacaacttcaaaaatactgttttacttcacatacactttacctctaggtttcatagcaagacaatagatgggtgtagttttagtattatttacttttatttgttaattcaaggcactatagaaatacttaatctgtttaaaccccaaacatctctttaaaatattttatgtgacgagcaaacagaacatcatgatctaataaaaatgaaaatgtttttgatgttaaatgttgaggtaaaacttttgttcagttattataaaataatgacattttgagaacctcttatttttaattttatcgtctctaaaattgagacaatcacatcttggtatcgataatttttgatgcatgatgtaatatttaaaggactttaaaaatgtaaaatgctgcataaatattattgctctgcttaacagtgtttcaaatacatttttggaaaaatagcaaagtaagagataacatgtatctaaagttctcatcccttatcaactaaatattatgaaaaccttagcttctcttgcttctccagaatgacagattagcttcagcctaccttagactaggcatatggaattggcaaacgctctccttagcaactgcaaagttcaccgcagatgcatttaacagaaatagcacagatacaattaagcaggtagaaagaaagaatgagcatgtaaaacacctacaatattccagatttcctgctcacttaattggatgattcagatacctctctttcataatgtccaggtgaaagaaatgccggttcctcttatttctctacatcaaactaaagctccacttaccagagcaaacacaagtacaatctgttatgttttggactgtctaatccattctctgtagtttcacaagaatctggtgagcttacatggcatccagagaacagggtgatgagtaaagcccttaactctacattgtctaaagaacctgatttattcaaagaggaggcagctctctcacttcttattaacagagggtagagagtttctttcccaaggccaagaggggttttagctattaatacactttctctccctccgtccctggtgtgtgtgtgtgtgtgtgtgtgtgtgtgtgtgtgtctgtttctctcactgtcaattttgagtggggtttcaaggtttaaataaggtgacaagtctagtagaaaaatctctgaaagagctatttgtagaacattaactgactagttgtgtgactttgtacaaccagcttaaggattcagttttataacagataagtttagggaaataaattgcactgcacattgccttcggtctgttgtacctcaaatagcttaggaatctgttttctcctaaaacatcttcctggaagctgggtttccgctccaccccacctcccatgtgtttatgcattcctctgctcctccccttaactgagaatcctcattagaggcctgggtaaaatgtttcattgttagagttataatatatcaataatttacattaccttaattttgtaatttcccagggcattttgaaatgttatgataacatgaaaaatgtatgactttcctcaatgaaaagttaattaacaattgcttttattcttcaatgaacagctttatggctaaattattactagttttgtttttaattagatgactaaataatgcaaaattagaccatctttgtcctgacactgaattagaccattctttggcaactcgtgtacaaactattttcatttttaaaaaaatgtatgattctgagaacaagtaaatgcaattagaattgtctttcagagggaaagtggccccaaatgatgtcaagaagccagttttatgataaagatgtctatttttatgaaataaaagtaaggagaaaaaaagaattaatacaacttcactttgagattttatttttttaattcttgagttaggctgaaggccagatttgtaattgctcgtgtatgtgctttctaaaacttgcttaaggaaaactggatggattttctaaaaggcaattaaagatttgcagttgaaaaatcatcctccctcataagtattggtgtatacagtggtttccctgcatggaggatatgctggacaatatattgagaactgcagctccaggcaaaattaaactagtgttttttagagatactaggattagcttgtttactaatttgttaaagcagctgcgtttacgaaatacataagccttaagttttaatcttagaaacaccctttcccaaatattctaacaagctcaatggtcctctgcctttgctgatatttagaacatcacgagagtctttaaaacttacagatgcctaggtcccacctgggaagtttctaatttaattggtttaggtggcaacctagtcactgggctgtttaaaagctccccaggtgactataatgcacaggaaaggttgcaagccattgaacttgtaaacaatatagcagctcccatacaaaagcccgtaaattcaaagaaaatccagccatatgaacaagaaaaaaaatgtcaacgaagcagggacttcataaacatatgtttgcaacaacacatcattgaatatgattaatttgatatatctgttttgttataaaatgtctagaaaaaaatgtaatgtaacaaaaccagcaagcaatttaaaacaaataggaaaagatgattagtagatcatatgatataatttttagataatacaggaatcggacattgaatttacgttagatttttatagacagatatacagaaaaacactcagagtagacaacaggatgttagcagtggtgctgcttaatgaaaaaatgagttatctgtacttttcttaatagttattgttgtatctttttatggtaaacatacattgtttttgtaacaggagagaaaaagtagtgttctttccttgaaccaaaaaaaaagtaggccatttaaaaattaatgaataaggaaaatacacatgaaaacttctggaataagaacaaagctgtaatcaaagaaaattaatagccttaatttttttatatttgagattaaagggaaaataagagaactaaacatttgattctgtaagaaacctttaaaaagcagtacaagaaataacttcaaaaatactatattgagaaatgctttcaaacaactaagtatgaattatctgtttacaaaattccaaaccatgaaaatagtatttaaacctctatgttcatgttctaaagcccttataatcttgattatgagacttcaaaaaaatagcatacacattgaaaactatcaaccaatctcaggaatacagacgttcaaatcttataaaacatagcagatttagccaataagagaagaagttatcatgccaaattggatttatttcaggaaaacatatatgcctactataagagaatctatttacatccttcattgtaggtaaagatcagaaggaaaaaatatacaatactttttagttatgaaaaagtattgataaatgaaaagaatctgtccctaatttaggagtagaaacaaaacttttagcaatgtaagaatagatgatagtttataagcatgaaaaatattgtctatctcaaaacaagagccaactctgtgatcaatgttgaaatattgaaggtatcctcattaaaattagaaatataactagaatgactaccaaaactgctctttttaaatgctattttgcatattctagtcagtgaaagaagccaagtaaaagaaacaggaagtataagtattggggaaaaaagtcaaattattcatattaatagatgatattgtcaacttggtactaagtaaatcaacaatgacaactattataactaatgggaaaaattagtcccaaagctcattaagaaaagaaaaaacctagaaataattaaatattaattaaatgtaatttttctaaatgctaatttctcttttaacaacctattgaaaatcaaagctatcattttccacagaagttcaaaatgtgaaattactgtgaatttatttagcatgaaatttggtgatatacaagcctttactggaaaaataacagaatatttgcatccatggacagatataattttatatttcttggtgggaatattaatattttagacatataatttactacaaattaagctaaaatctgatagaaacacataaaatttaaattggggtggcaggaagacattggatgtgacaagaattactctaaagtttatctggcagcaatatagatgaggattaatagaaaatgttgaaaaccttaaatgaaaggtcatttgcccatgtagctattagagtgtttaataaaacttctactggctgggtgcggtgtctcacgcctgtaatcccagcactttgcgaggccgaggcgggtggatcacctgaggtcaggagttcgagaccagcctaaccaacatcgtgaaacccagcctctacttaaaaatacaaaaattagccgggcatgatggcaggcgcctgtaatcccagctactcgggaggctgcggcaggagaatcgcttgatccagggaggcagaggttgcagtgagctgagatttcgccactgcactccagcctgggcaacagagcaagactctgtataaaaaaaaaaaaaaaatctactaaaagtctatacaaacagattagtgaaacaaaagagaaaatcccaaaatatgctcaagtgtatataataaaaatggaatttcaaatcagtggatagagatggactatgaaagaaatggttttgataatcatgttaaaaggcaaaaccctgctttacacaatgcagtgaattaaatttcaccttgaacaaatattcaatcataattaagcttaagaagcccaaagaacaggaagaacgataggtgaatatttctacaatgaggcgatggtagagaactatgtagaaatgattttaaaaacccaaaatttaaaatggaaaacacatagataatttttaaaatctgtacattaaaaaccagtaaactgaaattgaatcttacaaatcaattcagaaaaataaatgcattgcctaattttaagcatacaggaagaaagtgttagacctggaggtcattattttaagtgaaatgaaccagacacagaaagtcaaatattgcatgttcacccataattgtgtgctaaaaaatgtgtacacatgtacacagagagtggaatgatagacaatggaaacttagtagggtgagggggttggagtggagtggataatgagaaattaatgtgtatgatatatttgggtgagggacgctctaaaagccctaacttgaccactacacaatctatgcatgtaacaaaattacacatgtaccccatatatttggacaaaaagaaaataaaacacatccaaaggtatatgaaaaaatgttcgatctcatttgtaaccaaataatgaaaataaaaataacttttccttgtatactttgtatgcttctgacagaagactgaatcaatttatttcatgagagcagtttgcaataccaatcaagagaaagcgtgcttacacttgactaagcaattgcatttccagggaaattatcgaagaaatgcttacatctatgtgcaaagactgagttgtacctatatttattgtttaattgttattacagtgaaaaatggaaacaacaccagtattcatcagtaggaggctactaaaaaatgatatatctctaaagaagggaaatttaaaataaaattttacaggtgattgcattgatattaaaggtaatccaaatacatacatgaaaaaataaagcagactgtaatacacagtatgtatacatataatgctgtattatgatcccgcttatatatgcatatatattaaaatataaatttttaacctctgggaaatgcattcctacctaattttaagtctctcattttttcttattggaattttaaaaagtgtacaatgcttattaatgaatataaatttgtttgaatcaatgttttcaatttttaatcaaattatctgtacatgattcaagtaatttttacttcataagttcttttatttaaatatgctgcattcctctctcatttctcactcctcagaggcagatatttgagtcattctctttttctaatgcgtgacaaatctgtaataacatgtttatatctctaattcttgattttctcattttttcatggtctacagtctctcttatgagagatgaaaaattatctcatttatatctaccccatgtatttgttctattaactaatttttcttttacatgaagaccttaaatgttaatttttttcttcaaaacagtgtcaaaagtatgtcttaacccttcacatgataaaatggggattttagtggtcctccatgtttcttcacttctcctactgaatttcttctcccaaattctgtaaagtctacttttaattttatgttgagttgcattccttctgtgttctctaactatgattaggtctcgtgttttgtcaaagatttattctaaaaattgaaaacatataaacagtatgtacactattattatagcaccataaatatatttcattgcagagtctattaccgtgttgggcttatatttcctttcctatgatttccatggcaatttacctctgctactttacagaaaatttcaagattcaagttaaaatggattctctttttttttctttttttgttttttgagacagagtctcactctgtcacccaggctggagtgcagtggtgccatctcggctcactgcagcctctgcctcctggattgaagcgattcttctgcctcagcctcccaactagctgggattataggcacacaccgccacacctggctaatttttgtatttttagtagagatggggtttcaccatgttggccaggctggtctcaaactcctgacctcaggtgatccacccgcctcggcctcccaaattgctgggattacaggcatgagccactgctccagccaaaatggattatcttttcttacactcagtaatctctcaaattcaaataacgacataggaaattcctaagtctattgagtctttatctaccaaatctccctctctttcactttctctgtctctcttatgtacacgtagacacgcacacactcccttctcaaaaggtaagagaataggatggtttgtaaaggggaaacgtctctggaaacacccacactttaataatgtcttaactaatcacattgcttgggtgtttttgttattttgtagtttgcggttttgtttgttttattttctgataacctgcagagtaggaaagaagagagtccagaaacttgttgtaaagctggacttcaagttggaagaaatattggaaggaccttttaaaaagagagttgtatgatatcgaagcagcctatttccctgaccccttcccgggactcgtgacagggttgcctcatttacctagaccagttttcaactccttatgggagggagcatgcaagtgaattccaggggtttggggtacgaatgatcctgtcacccaggtactgagtatagtacccaatagtcagtttttcaacccttatccccctccctccttccccttctagtaatccctagtgtctatcgttttcacctttatgtccatgagtacccaatatatagctcccacttacaagtgagaacatgtggtatttggcgttccgttgctgcatgaattcgcctaggataatggcctccatcacagctgcatctgtgttgctacgaaggacatgatttcattctgttttatggctgcatagtattccatggggtatatttagattttctttatccagtccaccaatgatgtgtatctaggttaattccatgtctttgctattgtgaatagtgctgtgatgaacacgtgaatgcatgtgtctttatgttaaaacaattttatttattttggatatatattcagtaatgggattgctggattgaatggtagttctgtcttaaattctttgggaaatctccaaactgccttccacagtggctgaactaatttacattcccaccaacagtgtataagcattcccttttctctgcggcttcaccagcatttgttgttttttgagtttttaataatggcctttctgactggtgtgcgatggtatctcattgtggttttgatttgcatttctctgacaattaatgttattcagcattttttcatatgcttgtaggctacttgtatgtcttcttttgagaggtgtctgttcatgccctttgcctgttttttgatggcgttgtattttgcttgttcagttttttaagttccttgtaaattctagatattgaacctttgtgtgatatgtagtttgtaatgattttctcctgttccgtaggttgtctgttactctgttgatagtttcttttgctgtgcagaagctttttagtttaattaggtctcgcttgtcaattttttggttttgctccaattgcttttgaggatttagtcataaatgctttcctaaccccaatgtccagaatgatgtttcttaggttttcttctacaattcttctagtttgaggtcttacatttaaatctttaatcatcttgggttaatttttatacatgtcgaaaattagggatccagtttcattcttccacatatggctagccagtccatttattgaacagggagtcctttcccattgcttatttttgtcaactttgttgaaaatcatatggctgcaggtgtgtggctttatttctgggttctctactttgttccattggtttatgtgtctgtttttgtgccagtaccatgctgtttttgtttttgtttttgctcttatttaaatgttataaaaattgcctatatttaagatgtataatgggatgttttgatgtgcatatacgcagtgaactgattactacagttaagctaattaacatatccatctcttcacatagttattttgtgtctgtggtaagaaaacttacaatttactctcagcaaatttcaagtatacaatacagtattactgactatagtccctatgctgtgcattagatctccagaacttattcattgtatgtaactgaaacgttataccatgctgattcggttgctgtagccttatagtatagtttgaagttgggtaatgtgctgcctctggctttgttctttttccttaggattacttttgggctcctttttggttctatatgaattttagtatagcttttttccagttctgtgaaaaatgatgttagtggtttgataggaataacatttaattcgtagattgctttgggtagtatggccattttaatgatattgattcttctaatccatgagtatggaaagtttttctatttgtttgtgtcatctgtgatttattttagtagtgttctgtaagtcttctcatagagatcattcacctcttttattttttatggctattataaatgggattgcatacttgatttggtgcttagcttgaaaattactggtatgtagaaatgttactgatttttgtatattgattttgtttcctgaaactttactgaagtcagtgctatttttagatggatatatgagaatatttaacttatatggagagtcatagaaattacacaatttgtatttcatacatcatccacacacatgctttctttacttaccagaatagtggaaatgctgcataaaatgaacttaatggtttttatttcctttcttcataaatgtacagtttatcaagaagatgccctttggcttactgacgtgtaaggagggactaaaaggaaaggaaaaagaataggtagctctaacttttcctttctgtctacatcatcattttttattgcaaggtggttggccaatataaggaaggaacaccactaagaaaagatattatgtggttttttggtcattagtgtttcttagaatgtcactcacttcttcctgcatatatatatctcaaatatatatatacacgtatatacacatatatatacatatatatctcaaatatatatacatatatatctcaaatatatatatatacacatatatatttagaagattatttggtgaatacactattagaacaaaaagaaagaagtattagcgaagtgacagggtatttcccaactcagatatatgatacctgctaatggactgttcgtgattataaatgtagtatatgctcattgtagacattatgaaaaacgtaaaatcccctataattagacctctatttgtgctaggcacatgatgacttttcttgctctgcaacaactattttttttctcttaaagtttataatgttgtcagtattgtcggatatcctcagggattccatcatcttttcttaattgtggttaattacttaaccaattattacaaattattttcctataatttattgctcttagtatcaaacaattaaacaccctaggaaatgtcttattacttgatctatgaactggtgagaatctatattctacataggggcttgttttctggttttaaatctaatacagtcgtttggcaaataaagacaaaaaataaatgttgtctacctacttttcaattatccaagtagtttaaaataaaaacatccttactgattttttaaactcttatataattgcctaattctacagtaactggggttggtagtaactaaaacctgttgtattcctagtgatgcccaatgagccttgggaaatgaataggtgggtatagtccagttgctagaaaatacttgcttgttactgacttatctgagaggaaataaacactttcatttatcagggacagagtataaagtgttcctcactgaagcatttctaaaagctctacagtcctttgaatactgataaggactctgaaatgcaagggaaaatatgcaagtaatctggactatcacaggttattttatgaactgctcatatttttactcctttgataagtattatttcccccaaccccaaacccgataaattcgataacccttttcatatataatattatcagcaaggcatcttagagtttcctttaaaaaatgtaaattaccaagagaaccagaatgattttggggctcataatggtagatcttaaagagagtggaaagatcagtagttttcgcattttgctacacattggtggagtgtttacaaacagtgatatctgcgttctatttccacagagtctgacttaagtggtctgtaatccgagcatctcagtttgaaaagtttcctagataattttaatgtgtatccaacgttgaaagccagagtaaaatgaaggaagttctggggcctcagataagcaacttcactacttttttcaggttctttgaataattgacatcatccccaaattcaaatcgttgatagtcatgatgagtacctgttttactccagaaatctatataatattggttacctcagtgcttgctcttaacttccataatcaaaggaggaagagagactcatcgtgttcagatacaggttgtgtaacgtgtgtctgtaaaatactaatgtgattgacttcatccatccattcacctatccatccatgcatccatccatgtatacctcgtgtacctccattcgtctactcatccaatgtctctgtctaggctccaggactgctgccttaaggttgtttaccaactcagtaggtagtatgttatcctcaggctttggaaacaggggggtttagttaaagagcaaaccaactcaacatactagattaacttgaaagggaaaagttatgcttagtgcataaattctttccctcttgtcctttcaaatccatttttcattctttaccactgtgctttgtgtcctggggactgccctttaggaatggcatcagagttcctttgccctacagtttccagttgagacaggctgcagcaggaggagtacagtggataagaaaagggtggagtatttattttcatgtggccccatgggatttccacaggttagctctgaacagctaacattagaccagagcttctgctggacagttctctcttgcatttctattgggtctggctctctagttcaggaaacgtccttcctcttaacccttgaggtctacagttaactctccgtcatcccttcttgaatttcctaacactgagcatatctctgttgataacccctttagcaaactggcctcacataccccgagattgagaaatcaatcctccagtttctaccgggactctgattgagttaatgtgggataatttgcttacactaccctcttataaagtgactatgtacattagcatattaactcctttgaggattttcatttacttttgttattaaagcattacacgttttttgataatgtgtaggagactcaatcatagccagaagtgtctcagacgcaagcacctgtaatgattcccttatatacagttttatcccaccagaaattgggactaggcacaagtgttctaggtaacatttcaggatcctactgtcataaagattattatggcacaaaaactatttggctagaagtatccccagactcctctgtgccacattatcttcctttatccagttatctgaggatgtgcttgcagtggcagactagcttttggggaaattttatttcaagaaaaaaagcagggaggaagaaaagggtaagaaatgaggaagggaagaggcccatgggctaggagtgggctgtcctgtttctgggaaactttgtgaaggtttcaggagtagtagtaactcatggtgaatgaaaatgagagggaattgttggcttttaaagtaataggatatgcccctttatgatgggattaagagatacaagtaagctgggcgcggtggctcacgcctgtaaatcccaacactttgggaggccgaggcaggcagatcacctgaggtcaggagttcgagaccagcctgaccaaagtggaaaaagcccatctctactaaaaatacaaaattagccaggcgtggtggtgcatgcctgtaaccccagctactccggagtctgaggcaggagaatctcttgaacccaggaggcggaggttgtggtgagctgagatggcgccattgcactccagcctgggcaacaagagcaaaactccgtctccagaaaaaaaaaaaagagatacaagtaaagttatgaaatcacctgtggtttctagacagttttttttgtgtgtgtgaaatattaagaacagaatacatgtgctaaaacattttaaaagcttaataaggtcttttaaatcttgcctcttccttttgctcgtctaatattacctcctatgtccacccccacggattatttacatttaatgctttctagtgaaatcattaaaatgagatttatggattattcataataggcaggatgaaaaaggaaggtgaggcgacagtgatccttccttagctgttaatggataaggagtttcacagcaagaggaaaaaggcataacattagtattaccggttgtctaagggggagagatagaattgtttttttttccttgcattttctgtactctactcttatttccaaatattctttaatgtttgtgtgactttgtgacttctatattcagcgcaaaaaggattaaagaattaatttaggaaatcaatttacactgagtgtctccagtgccagagagggagggaaggacattcgtagctacagtgttcataatagcaaataattgtattatggtcataccatggaatattatatagcagtataaataattaactatgatcacatgtaagaatatgagaaaatcataaaaacataatgtagaggtccacaaacattttcttaaagggccagatagtacatatttcaggcttctaggtcatattgcaaatacctaactatgttgttgtggcatcaaagcagccatagttattatatgagtgaataggtgtgagtgagtctaataaaacttcatttttaaaaactgtcagggaggccgggcgcggtggctcacgcctgtaatcccagcactttgggaggccgagatgggcggatcatgaggtcagcagatcgagaccatcctggctaacacggtgaaaccccgtctctactaaaaatacaagaaattagcggggcgtggtggcgggcgcctgtagtcccagctactcgggaggctgaggcaggagaatggcgtgaacccgggaggcggagcttgcagtgagccgagatcgcgccactgcgctccagcctggggaagtgcactcactccagagccggggagcccatgggcggtagtgtgctgacccttgtattagacaacactccagaaagctcaagcataggaacacctaatgaaaatattgttttggcatacatgcatgtgtgataaatcgaaaaaaccaacacaaaacaaatgagcaaacaaaagaaatcaaaggcaatgatatgacaatccccagattctggatggtagttaatcctgggtaaatggagggaggggtacaaaagagtgaagaactagtgtaggagcacataggttcaggtgtgagttgttgctaatatttcagttattgggatggacatatgtttgttttattattgagctttgtaatttacatatccattacatatattcttttatgcatcaaatatcacattacacaaagggaaatcataaaaattggggaaaaattggaggcaagcatagatcttggggcccagtgtagcatgcttttttctatttttaaatttaaaattgtttttagagatgcggtatttctctgtcacccaggcttgaacccctaggttcaagcaatcctcctgaatagctgggattacaggtgggtgccacttcacctggctaactaaaacaaaattcttttaaagatatggtctctctttgttgcccaggctgatctctaactcctggcctcaggtaaccctcccacctcagcctcccagggggattataggcacaagtcagtgtgcctcacttccttcaacattcttaaatacatcttggaagcacagtgtttattaccttgtttctaaaagagatgcatctattgtaatcatatttataatgttcttatatatggttttcattagttttactgaaactctcaacctattgttttttgatgatgactaccaatattcattgattcactgataatctttgtaatgtccttaactcttagggattagatgacattaaatctttatcaagaagtggattttgttacttaagtattttagtagcaacaaaattggtcacaacgacattccactgaagcagaatagtcagaaagcaatccaagccgcagaaataaattaggttgagcaagactacacctaatggcattgagataaagaccctactcctgactcactgccccgtgttctagtggtgtgcctgctctgcaattctccttaagttgatgtgcatctatctctttaggaccagggggtatttagtctgtaatggcttttccggcaacgtgtctcatttcagctgcttcagttgtcgagataacactctcgtcactgcctctctgatggtttcccattcaacagcagtcatttcatcttgggacacttttcctcacagtcaacagtttttcctttgtgtaattaagtctcatttttttctggatagatccatttgtgccagaactcttctgctgccttgaagcctgcaccattcagttatttttagtgttatctctttcctttcattagcacagagctaaattgtgcatattttgttctttcagctttatacagattaagatcttctagctccttagtcattcattttagctgttgcattgaatttcctacagttcatttaaatcacccagttcagtttaatatgcccagaataaataaagcatcattttttttcacatctaatcacctaccccgaccaatggcaagtgtaaggattataaacctttgtgactttgcctgtttactcccttagtaggtgagctctgagccaaaatataaattcattaaagtttttcttaatatctctagtctctacttctggctcccttccctcagggtattatcccctttacaaatatttttttgtgtctttaggtttccatttgttttttaaaaatacattcttatcaaaacgggaaaatattttcccatttctttcataaaccatgttttctcaatagttatctctaatcaaatacaagaaacagggaaataggtagtgccttacaaaggaattttagccatatacgtttggataaggtgaattttccatatcctggagatggttttgagtactcaggaggctacatctgaaaaaaaatatatagttattctctatctgggagtcaacttaattcttttgatggaaaaatagaggctgtgaatccccagctccagctggcagagatcactttgctcagaagttttgcacgtaaaaagaaacttcttttctgggatcactgatttatttcagctgtaccctgaaactggtagtcagatacaccctgtaaccagcagatctgatattctccagccttttcgggcttgtacatcaatcgtttaaactacactataatggggatcatttgccaaagctcattgccattctcttctagtcataccaatttataattacttttctctcaatatgtacccacgactctcctttcttcacccttatgatatttattcaaatattaaatgttgccctttttttctacctttattccaaatgccttagaggtctggcgtaaactatatggctataacctattgcatttttaccccatagatggaaaatgtattggtgaattgtttataaggttggaagttcccctgaaaataaaatccacccaccccactaggggagtacggaaactatatataatatgacacacatcgctattacttttattacatatgcttattatttattgttcaaattttcaaatatggtcctgcacacaggcaattttcacaaaagagcagtatcagtgttaatcagtttgaaacaggaaaggatttgtgaccccaccttacaaaatacaattccttatggttacaaaatctcattcaaatggattctattgtagccatatcaataaggaaactgatctatcagccaaaatcggaaatagccctgataaagtagactgagcttacattcatgcacagatgtttgctcattatttttacttgataaggacagatacgtttgtgtttagcataatgcgtgtgtgtatatttgaatagattttctagaccctcattttagttctagtaacaattgtctggttctgaatagggactttccactttacagaagcaggcaaaatttaatttgtcatagctaccactgaacccatttcctttatatactcaatctgctttgacacagtagatattggagtttcaaaccttaaaatgaaatacagctttatgatgaaatataagttgatatgaatactttcaatatacctatattctatgttacactcagttagctggcatttggtcttcactcatggacattttaaaaactcatacattctttagtgtttgataatgtgacaaatcaaccccctataaaattaactttaaatcaattgatacgttagcatgtgagtatatgtgtgtgactatgaatacatacttatataagcacacttatatgcttatacgtttgtttgaatctctcactgaccttagccataaaaacacttttattctgttgatttatacctcagcctacatgtgaacaaaagattcagcaaatcagaataacacagttactctattttctaatttatttgtaataaatatgcattacctgcataacgtttacatcaatatgggcatacattacttatgcaatgtaatgatctaaataacgcaactatcgacagtaaccacgcactctccccctagcaattacagaatacagtttctctgttgcacaacatgcctgactatcgtaaatttagggttatctccttattaggattccatttacactcttaatgaatcatatttattttatagcagcttattagtaaagttgactgccaagatataggcaatacatacaatttcctcaaaaactggggctttcactgttaatttaacaaacctatatgaatccatataatatatgaatcatatgaatatatataatatgtaataagataaaatgcataatttaacatatatgaaatatatatagtattaattgttaatatgtattaatatagtataaaataatatatataataaatgtataatatataatatatgaatcatataatagaaaaatatatgcatagacttgagttaggtgtaaagaatggaaaaattaaaaaatagtgcacttgatgagttcacaacctagtatagtgtgtcatagagaatgtagcattttgtgtatgcaatagtaaatatatataatgcaaaagaaatgaatggttttgcttagggtaggaggaatggggtaatatttgagataaatctcaaagcatgtaaagatttatcaaatgaagaattggggttatggaggagtaggggttgcattccaggagggagggaccaacatgtacaaaagcttaaaggaatgtaatttcatagtatctgggaaggacaatgggtagctatatgtttctgaaatcttgaatgcttgggtgaaataccaaaaatagggctagaaaagcaggttatgattagattgtgaaggcatttaaaagcgtcttgattagttgggaaataatttctacaacgttttagttgtataaataacaaaagcttcttttaatccagatacttagtggaagttcctctttctctaagtagaatactagacctaataataataataataataccgtatcatatatttttattacttttttggttttctgactactttcaagtacagagatggtccccgacatacagtagttcaacttaacaatttttcgactttaggatggtgcgaaagtgatactcatgctgtggaaaccatactttgaggacctatacaactattctggttttgactttcagtatagtatttaataaattacatgaaatattcaacattttattataaaataggctttgtgttttatgatttttttcccaactgtaggctaacgtaagtgttctaagcatgtttaagataggctaggctaacctatgatgtacagtctgttaggtgtatcaaatgcattttcaagtttcaaaatttccaaactatgatgggtatatcagcatgtaacttcattgtaagttgaaatgcccatcaaagatagactggataaagaaaatgtggcacatatacaccatggaatactgtgcagccataaaaaattatgagtttatgtcctttgcagggacatggatgaagctggaaaccatcattctcagcaaactaaaacaggaacagaaaaccaaataccacatgttctgtcttataagtgggagttgaacaacaagaacacatggacacagggaagggaacatcacacacctgggcctgtcagggggtggggggcaaagggagggatagcattaggagaaatacctaatgtagatgacgggttgatgggtgcagcagtccaccatagcacgtgcatacctatgtaacaaacctgcacgttctgcacatgtatcccagaacttaaaatataataataatataaaagaaaagtatctgtgcttgatgggttttgatatcctcagtaactatggccaattagttgaacatggcacagtattatccatttgcagtagaggaaacaaaggagaaaccagaggaacagtgagagagagagagagagagaaagctgctggtcatgtcctctttccagcatgtcaccctccatattcttcttcaaatcaaaaaacgtagaacggaagggagcttagtagcattcagctctgctacactgcacaccagctatacacacaggcaatcaatatggtttggacacagctgatataatttggtggagctctaattgaatttttccccttcttaatataattacacctacagaacgtctccaattaagtgtccccccatcagtctcaaaattaaatataccaaatggaactcattatctactcccacataaaccagctcttcatgactctttcccctttctattaagcaccactgcttccaggctcctatatctgaaatccctgaagtcgcttatttttgtattcctttctccatcccgaaatccattcagtcactgaatgctattgactaatgtttgaaattatatctatgcataccttcctttacgttatgggtaaatgtttttggaatgtgtttaaacagaacaaggaattggtgaacaaaagaataaagccatgcataaacaaatgtttattcaccgttttcattatatttgtttgtagtactgcaacctaaagtttgtaatgtctgagaatatctgattgtaagcaattaccccaaccccatgtaagttaacagtgttataactggtacgtctccttataggtgaatttgttcaaagttgcttaattatattttaaaaatctcttattttagaaagaactctcaattgctttactctgaataagataatactgtttagaagacaaatcattgcaagttttacatctgtaagtaggttacctgatgaaacggattgaaaaactgaaggcaaatattgaatgttagattattcccaggtatctgacttcatcttcttacttgctaggtgtcattgttaatgataatttaaaaaatcacacatacctacgtatccacatatacaaaacagtaagcagtcatgctattgaattcacaaatatacaccaaaagacaaggggaaaaatataaacaacagctttcttactagcaagcagagtgtggcgtgaggtcaaatttttatgacgaagagcatacatattcacaaagtaatttatctcaacttatgtagctggaaatggagttgatgggttctgaaaaaagcttctagatgacattaaaaaaaggggttcttatgacaaagaaaaaaattacctcaaagtagctttcaaagagatcgaataaagtcatttcatgaaatgcgagactaaaaaacatgccagcatttctaatatttctaatgttttatatgatataaatatgaaatataaaaatatttaatatttttatcatagaaaattaatggcatcaatttcttatcaaaatcatgcatacaattgattatatatatttgctaaagtcctaaaattttgtgtatacatgttggcctaaaatatttttgagggctcacaggcatattttcttttgggaaaatggaaactgcctaatacatgagatgatttatatacatgctgcattttacaagcggttagggaaacacatgtctattttttttctaaatcaaataatccgtgtgtgcaccatgctaccttgaatatcagattatcagatttaccatccctattagggatataaatgttccagaagaacataagagcaaatttttagaaagattaatacagaatctaaagattgaagggataagatgatttacattaaatctgtttccaggatatcctagttgggaaatcaacctaaatacccgaaaacttaaataatccaagacagtatgcatttgcttaacagactttttctccatcatttgtctgtgtttagtaagataaaagaaagacttgcggccgggcgtccgaggcagcgggtcacctgaggccgggagttcaagaccagcctgaccaacatggagaaacatcatctccactaaaaggcggaggttgtggtgagctgagatctggccatcatactccagcctgggcaacaagagtgaaattccatcaaaaaaaaaaaaaaaaaaaaaaaagaaagaaagaaggaaacttgctacccctcagtaaacaagttatatttccttcataactttcttcctataaggcaataaacaaatatttattaagaacctatcatgtgccaagtaaataagtactctgtcaaaacaagttagattcagagtgggctggaatgatttggacagaagggaatgtgagaaaggctagataagatggaaacttttctgccacaggcataccttcccagtagacgaagtagagatacaaataatgtagcgaagggtactatggaataaaaaagtcaataaatttatttatttagtgattacagctacgatttgctaagcaattaatatatgtcagacattaagccaagacctctgcagatgatgccatgtttagatcttataacaacctagtaaatgtgttaggatgatcaaatccattttattttatttaaattaaatagttaattttaatggatagaaaaaattgtttatctttatttcattcaacatgttgttttgaatatatatatatgaatggctcagtcaagctaattaacatatttattacctcacatgcttatttttttgtaggaagaacactttttttttttttttttggagatggagtcttgctccgtctcccaggcaggagtgcagtggcttgatctcggttcactgcaacttctgcctcacaggttcaagcgattctcctgcctcagcctcctgagtagctgggactacagcctcacgccgccacatcctgctaattttttgtgtgttttagtagagacggggtttcactatgttgcccaggctggtcaggaactcctgagctcaggcaatccgcccgcttccgcctcccaaagtactgggattacaggcgtgagccactgcacccagccaagtgaaaaacacttaaaatctactctcttagcaattttcaagagtataatacattgttatgaaccacctgtagaatcaacatgtacaatagatctctcgaacttatttctcctgtctaaatgaaattttgtattctttgatcaatatctctgcaagcctcacaccctcctcccagtctctggtaaccactattctactctctacttctatgagcccaactttttagataccacctataataagcgagatcatatgttatttggctttctgtgcctggcttattgcacttagcaaaacttcctccaggattatccatgttgtcacaaatggtagattttcttctttcatgtctgaattatattccattgtgtgtgtgtgtgaccacattttcattatccattcatttgttgatggacatttaggttgaatccataccttggctattgtgaacaatgctgcaatgaacacgggagtgcacatatcttttcaatataatgatttcatttctttgggatacatactcagtaatgggattgctggatccatactcaatttaaagatatagaaaacaagccataaatatttatgtcccccaatatccaaaagttaatcaatggccaaatcagcttaatttgtctgttttgtttttactatcaaacttaatacattcaccaatgctctttttcatagttgtagccttttcttgaagattataacgtttagtagtttagattgttatgtagacatgtggtgattaaagtaactcctgcaattaatttaactaattttagttatcatgtactacacttttacatactatttccctcaaaaatgttaaaaagcctttcttaaagcctttttagcagtgccttttatatttattcgtgttactgtttcatcaattgctttagtttggtgacagtttcatgtagttcatttactggattcaagttacagtccagttacttgaggggcccaaaagttaaggacttctgaaagtgcgtgaattgcttctactcactgatgcatcccaaacattcagatcttgttacctgaatcaggggttctattctttaaagttccttggaggatactatcagaatgaaaagactcaaaatagaagtcttccggaatacaatgttgtggttttaaacttaaaagtattgccagtacaacgttagtatctactgaggtggtcacactcattccagcaggtcacatactgagaactgcataggctttgtatggtaggccaaaataactttcagattgagtccatcaattatttttctaaaaaaaaaaaaaaaaaaaaaaaaaaaaacccagagtttttgaaaaacctacttagtcatttggaaaaatactatgacattgaaaatcatattcctggaatccctaaacattattaccaaaaccatcggccacagagctgtcttctactttttccccaaccccactaattccgagtgtatctgttcttaatattcaggttatacttaatattccatcttaatattttattttaaacacgttttatgctaaaaatttacacatatatttataatgttctttctttggggatatgaggattctactgctgacctactgctgaagtactaaaaaatagtacttcagtgtgtacagtaatagggttgagcaatttattcatgtcccagccaatttccaagtatccacacacatttcattggcaaagtattcatatccactcatcagagtttgtaatgtaaactgtttctaaagaatattttctcactctttcagaggagaaaatcagtgtattttaaaacataaagctaataaattccatcacacagaaattaacttcaatagggctgtggtttgaaatatgttgtaatccactgaaggaactcaggtaaaactagtaggttagctaatatttattttttatttttatctttaagggacaagatctctctctggcacccaggctgaagtgcagtggcatgatcatagctcactctaaccttgaattcctgggctcagatgattctcccacctgcacctcctgagtagctgggacaagtgcacaccacgccctgctaattttctttttatttttcgtggagacagggtcttgctatgtttcccaagctggtctagaactcctggcctcaagcaatcctcccgcctcagcctcccaaagtgctgggattacaagtgtgatccatcatgcctggtctagctaacatttttcttttttcttatttcataaaattgagactcactttgcatccatagacttatggaaacattttgaatccagatgccgtagccatttttttgtttgttttggtttgtttttcaatatcaatagaatcttttgtaagcaaaagaaagcaaggacttctttaataatttctgatttttatcgtggcatttcctcactctcctcatgccagcatagtccaaagttgctatttgctcaacattattcaggtacttaaatgtttaaacttgatagtttttaatgcatctataaatttaaacataattctggaaagcttcattttctataattaaaagtgataatctatcttattttaaatgtatttctgtcttgggtatcttttcctaattaaaatttaaactcttattttacaatgagacgttacctcatttatttttcattaaacaaataaaaccagacaatccctgaaaaacctatgaagaattatctttttaaaaatataacaaatccatgtgatgaaaactatctttttacatcaccactacacagaaagtttttcatttttttatgtaatcactattaataaaatcatccatgtaggacaataggcaattatcgttaacacctatagcaaagcatagataaagttgattttttgtttttgtttttgttttttttttaagatctcacttctgttgcccaggctggagtgaagtggtgcgatcttggctcactgcaacctctggctcccggggttaagcgattctcccacctcagcctaccgagtagctgggattacaggggtgtgccaccacacccatctaatttttgtatttttagtagagatggggtttcgctataatggccaggctggtctcgaactcctggcctcaagtgatccccctgccttggcctcccaaagtattgagattacaggtgtgagccactgcgccccaccctgacaaagatgattttactttatcttaacctcatcctcataatggggtttgataattacatttcatattttgatcacttaaaattatttttgttagtagcattagtattttgtacatgaggaaaaggtgctatgtaaccatcaaagtacagttctctttctaacggtaaaagtggttgtgcaaaatgtagcagttaatgtctataaataggagacatagaattctatgtttctctcaagaagaatttctgttaaaatataggaaaaatatatcaattcatatttggtatttatgtagattatgttatagtactcctattttacttttgtaatttaataagggaaaactttttaaaatattcattcagtgagtaactttattgagactctacaatacagtgtaagatttatataccaatactacaaccattttactgacagaaaaataaaaatctagaacagtttcagaaatgctgcctttttatgctgttctccccaaagcaggggtccccaaagcaggggtccccaaaccctgggccccagaccaatcggtccgtgacctgttagaaaccagggggaacagcaggaagtgagccccgggcaagcctgagctctgcctcctgtcagataagcagcagcattacattctcataggagcgagaaccctattgtgacctgcgcatgcgagggatctaggttgtgtgctccttatgagaatttaatgataaatgttgtaatgtgcttgaatcattcccaaaccatctccccagcccaagtctgtgaaaaaattgtcttccacgaaaccagtccctggtgctaaaaaggttggggaccacttccctaaagcttagggggtaggtctaaatattttctcaagactcctctaagtaaacacataaaagcataattttaatgaaagcacttgtatattactgcaaatgtgatacctgaacttttgtttgcttgctttcttgtttgttagcttttgagaatacaattgtttttattacttagagagtatacattgaaggaaattataagaattttcatacttgaaagggacaaaagaatatgcaataggaaacagtaaaaaaaaaaaaaaatcatgtcagggctttcaaacctatctgcagaattcctttcaagtttcagtcctttgggggagccttttagctctctgcaccctctccttctgcttatgtgtaagccttggtgatgcatttaccaaacccttcatatctgtaatcatgaggtagcttttctccttcattgtaaatttagggatagtagaaactgccttatttaacattgtatctcttatataaccttacatgtaccatacatacatagagtctatgggataaataaacgtttatacaaattaaacatgagatggatgaagagataaacggatggatggatgaatggatggatgggtgcatggataaataaataaatggttggatgaatatgcttataattatttctatgtaaaatatttttagtgttaatgacccccaaagtgctcttaaagctccaattacctagttaattgcacatagtacaaaattcatagaggtaaacaaaaaagaacgcataaagaaaattgtttctcctattatgttagctagcctcctagttatcctccttctctcttactgggggtgctggcattgcggttttctgtgtattctttcagatatctgctgtacatacatgcgcatagtcatacacatggccacgtatatcagttcaaatctgtcaggaaggtatgagaacatcaatttcctcataccataaaaaacgcagtatactaccaaacttttgatctttgccaatatgattggtgaaaaactatgaaactatgtcttttagtttgcacttatctactcaggaatgaggatgaacatattttcaaatatttaagagcaatttttgttactttttctctgaattctgttcgttttctttgcaagttataatattccttccaaaattgttttataaccagttgacagatgggaaccagtctctaggtggtatcagaaacagtgttatccagcatattcaaacctaccaacttattcgatttatcactatagctaattgtttgagtagttcatacatttatttacactatcaagaaaaacagtttcaacattcttgaccatatttaaaaatgccttttaggctacaaaggtagattgaagagagaagttccaaacagtaatgaaggcctctattccatcccagggaatttgcaaaggctctttcctggacaaacttgtgctattattttgcatgatggaataattttcatccttcaaatctgtttaattgcacatccaaaaaaacaccttctttgactatgaaatccagactagttctctctccttccctggactctctattttaggtactttctatctgaacatcttgtttatttcttcaataacacttattatattgggtgattatgttattttgtcatttatttgctattccctacaatagattggaagttccatgagagtagtttccttgcatgtcttgtttactgttttatcttcactgcttgatccatagtgtggcatgaagtaaacattcaacaaatatgtgcggaaggaataaatgaacatacacatctaatttctggtgtgtttatcaaaaattcaattgtatacttctggtagactgaatttaattcaattgagtttttcccatgtgtgataagaaggatagggaaagggacagatggaggatgagagggtaggagagaagaagagagaaagagatgggagggaggagaatgtagactctccaaggagcctaggctttttactgcatttatttattcacaatttactgcaaatgaatttcacagacacagaaactgcaagcttagacaccatcattgctctgagacaaatgcatccagagtgtatttgaagttcagatataattgatagataaatgtaaagctgggagaaatttattaaaaatgattggtaactcataactttcaaggaagtgaattgtttaaaaaatgtacataatacttgggttagatactgtgtttcttagttaaaatataataatatatgtatttcaatagatcatatatgccaggagacacctgggcgtattgactattacataatagtgattatctttatccatctagtgtttgattgaggacggaggttgatgtatcaaattaaattaattgagatctaagaatgacatcaataaacaaaatgttaagtttcaatcttcctttttgcatatgtactgctttaatctttcggctattgatcaccagttatgtttgcaaagatcacatttaggctttcctttacagagagatttaacttaccctttaaaccatgagtcagtgcttttagttttggggatttagtttccttaaagccctctgagggaaagaagggtatatatagttatatatctccagagaaattgaatatcaaagtctatataacatgtaatttatcaatgattattaactcctgcacttgcctgtgactgcctgtatttggtgatgaagaaaatatagaaaagtagatgattagaatagggaacctaggaaataggaattggaatgtagataatctacagaacaaatggtatcttcttttatttcaattgtcatttgaaaaactttctttgaagagtaaataaaatataacaaatcgggactgaattcagtagaatagactgaatactactaaaacataaaaaataaaagagctaaaaggtaactttaaggtgtagctttatgttcttacatttatggcatgagtgcaaggaaaggctcaacagttacatgcatccatttactttatagttgaatagtaaaaaataatgcagtgaaaagtaatacttcctagggatgttcttagacatgcaacctgatcaaaaaagtataaaacaggttggatagtatctctggaatctcccattaataccaacaatgccttttcatcaaccaacactatttgccatagtcttctcaattctatctggacttcctgattttgatcttttcaagccaatccttttacacactgctctcagacttagtcatctaaagggtctttgatgatctccattgtcttaagttagaagtcctaagcctggcctacaaggttctctattttttgtcattttcctattttgacttatttcctccactctttgactgtcctacttaaactttaaggcagtctccttagacctggaatgctgtttcccactttctcaacctaccaagcttttgaacgtcctttgggacccagacaaaatctgatctttgccgtgatacatttcattaattctctgaggtggaattagtctccctttcctttgattcttctgtagcacctgtaagaacctgtacaatagcaggtatcatattgcatggtaattattttccaaatgtccttctcctcattccaattatgtgtacttcaagggccaggacattgaatcattgtgtgtatcctatgctggaaatatattaagcttccatagagttctcatgtaaattattgtgaaacatttttaatgctatgaagaaagcattttaaatctgtttaagaatacatgttgaccgggtgcagtggctcatgcctgtaatgccagcactttgggaggccaaggcaggcagatcgcttgagcccaggagttcgagaccagcctggacaacatggtgaaacctcatctctgcaaaacccacaaaaattagctgtgtgtggtggtgggcacctgtaattccagctacttgggaggctgaggtgggaggtttcacttgaggcgggaggcagaggttgcagtgaactgagatcacaccactgcaccatctgggcgacagagtgcgaccttgtcacacacacgaaaaaataatacatgttgaaactttgggaaggttttgaagcaagttttgattaaataggacttagatttcaggagtcagttttatcttcaatgcactcaaatttttcagataataaaattatttaatatacagtcatactaataatatagacccttgcaatagataagttggtgtgtatgcgtatgtccaacagaggattcctacagtcacatatattttagccataaaataggaaatctaaataagcacctttgtcttagacttcagcacaataggtcgaaccttcatttgaatgtgactagggactgccaagtccctactgcctatctctaccaaaggctgatctggaagtgaacccttttctttctttttttttttttttctagcagatgaatgttattgagtttatctgtggtctagtgatgatacctgcagagcagcttcatttttcagagtcattcagaaagctatcataagcttcttccttcttgtcaggcagagcaaatcctggcatgacaggatgtactgggagtctccgatagtgggaactgacaaagatgtgccttcagcactcccacaaagccatattgtctttctggaaatgaggaggatttattcagcaaatctaagtgtaaactaggagacccatcagataaaatccatacaacaaagatcaccaaccattttttcttcttctgaatagagccagaagatgcaatttaccttcttctctttttttccccagaagtgacaatatagagttagagagaaattatagagcggagattttgaaattcagtttcctccccaactaccagttgaaaaagcatagccttaggaaatgttctcatttgatttcctatgttttataacatgttatgtttgtgaatttgtgtgtgatgtgtggtggtggtggttccaaaatatctaagatatatagtaaatgagcaaacaaaaatagtttgtagcttttgatatatcatagttgtacatattttcgtgttacatgttgtattagttcatttttacacagctataaagaactacctgagactgggtgatttataaagaaaagaggtttaattgactcaaagttccacatgactggggaggcctcaggacgctgacaatcttggcagaaggtgaaggggaggcaaggcacatcttacatggtggcaggagctgggggatgtgggggggggggaagtgccacacttttaaaccatcagatctcgtgagaactcactcactatcacaagaaaagtctgagggaaatctgctcccatgatccagtcatctcccaccaggtccctcccctgacacaaggagattactatttggcattagatttgggtggggacacagagccaaagtatatcacatgtaatattttaatcatgtatatactgtataaatgatcaaatcagagtaattgggatatccatcatctcaatccttcctttctttgtgatgggatcattataattattctcttctagctattttgaaatatacaatgaattattgtttattatactaccatatactagaaaaaatgctctttaaacctcatcagaacacttgctaaattgtctttctatatgcttatgacaacagtaaaaaacaaagatcacatgtccaatattactgggctgtgcttggaaaaaaatattttactcttttttaaactttagccaattatatcttcaatagatatcaacactaatatcacatctttaaaaagtttctatgggttttagtaaggtatataaaaccatcaaatatattatccagagagacaatatattgacatttaaaatatgttcttactcatttatggtatcacctactgtcagaggtaaagtaaatttaatgatgtctaaagggattacagttgcttaaattggctagagttttatatgatttatattttcattcttttctggacattggaatcaagtagtaaattttgaaattttatattatatttttacttatcctgtttacagtatcacacctgactcaatttagagtagaaaatatttctagttacccttcgtcagaatataaacatcttttcaaattcatttcagcattttaattgtgttaatagaaatagttcaaaaatatagcataaacctcagcatgttctattttggagagaaggaggacaatgattgttgactctgatggatagtttcccaatgtgaaaagagtaaatttttcttcataataatattttatttcatttcatatggtactctaaaataggcaaaatatacctttacctctcttctgaatactagaagtagaagtaaatgattttattattgacattattaattatactatatttatgttgatatgatgccttacagttcatcaatcattttcatatattttaattcatttggccctaatagctgtgaccacctcccagaatagcccagtcaaaagaggttgaaaagaaaaatcatacaaaatacccatgaagtttaagaatttatggcacttgaaatatttgcccttagacaatgttcttagtatttctgagcctcagtttttaatacatgaataagaatactttaagtattattcttccacataatgggaataagaatacttactccatgaaatgagaataagaagacttactttatgtagctactgagggagtcaagtgaggaacaattactaatgccatgacacagtgtagatgctcaatactcatcattcagtttccccttttgaacttaaggccagaaagaagtgacttcagtggtggtactaaggagagagggggtgatttagccttcgcttaacattcatcagacctcacaccaagccacaggaagcaaatatacaatctctgaaaatagggaaacctacattcaagacaaatcctgtgtgtacctcctccccttcctctcccagaaaagatggctatgtctgaatcacaaaatgtaagcggtcgcctaaaaattcagaaatcaggataaattatattttacctcattttaacaattaaaatcaatgcaaaataattcatatgagcaaaatattaaaattttaagagaatacaagatgtaatcttgcattcgtgccactcatgttctctggcctcatccttatctccacttaaccaccaactgaaggactagaaagttggcaatgacataaagcacagcttcctcatgccatcttcccatgtccccccaactttgggatagtaaacattgcctgaatttataatcctgtaatatttttaaatgttttatcagatacatatgtttcaacaatatttgttccagtttagtgtagcaggtaagactgtgggtttcagagcatttccacctggatttgaattctgtctacactaattactggatatctgaccttgggaatgttactgaagttctctgagcctcagttttctcatccaaaaaaaaaatggggacaataatagtaaatatgtcatagggctattgtgaacatatgtgagaacattaaaaatatttactgtatgacacaaaatgttttagtttgtttttatatttaaatgttattaaaaagatatttgggactcatattttcctcatgcatcatcccatccctagaatttatcttgattgttttgtgtagcagtcgtttctttgactactatgtaatcaggttaactgtccattttcctgccagagggcatttgggctgctcgaagatttttcgtttattgtgttattttgggcagtgctgctaggaacattctcctcatgtttccttttgcaaatgcctctctgtttttgatgttgcagatggattttaccttgccatggcatgaaatccaaaggctgtacccacagattccgatatttatctcttgcttgtccacacctagtaataaactttagccaaagcaaactgttgcttgttactatgagcctaaagtcgctgtgctggtccctcctgaatccttttctatgagtcgcttagtactcttgctctcaagctctggtctgtaccgagctgacagctttttttatttctaggactttattgctgttttaaagtctttccactctgaatctgtacctattcaccccagagttagttgcatttctctgtgtctctaacctgagggtcatgagtctgactttgctcagtgaaggcaaatattttcttcctctgcagtctgtgttcattttgataatgatgcttgatggggggactaagcatccccctgagaggaaagaatctcgtttggattgtaatttgtcacagtttgtcttagtttggatttctttaaaagctaagcctgaggcgaggactagagagcaactagctcatttggtagctgatcacagggagcacaagtgggaggcaggggaagtaaggaaaaacgggggaaaacaatagtgagtgtattattcagctggctactgcagtgggaaactgttgttcaatcctgtgaagacccctctgaggaatgctgtagaatgtactcataattgtccctctgaagaataagaggctggggaatatgtctctggttcctgtgcctcattaattatttctcagggacatcaggtcccctcctgtgtgttggatgagtgagtttctataactttggacaaagtcgtgaggctgaaacacagagaagcagtgggtgcttgacctggtgggctgttagcatgcccgagactctccattacagggctgatcaagccagaggtaaaccaacagagtgggcagtgtctgctacacagttccaactggatttcccaattacctagtgctatggtcttctttgacaacgtgtctcaagaaggtaacctgtagctctagcccactgctactgaatgtttcatacctggtatcatgtggattataactgtagtatttcatttttcaggtattgtagtatcgaaaagccctatagcctgttttccttagtataaattttgattaaattatgcaagtccactttaaattcacagtttgatgttatgtacttaggaggcactcaataaatagttcttaaagcaataatttttaaatgactttttgtattatgtagacacatattaactataatagagcccttcggcaggaaaactgtttcttcaaagttgcaaagtgactgacaacgatatatataactagaagcttcaagaaaaatgttaccaggggccacttttaaactagggggaaaatcgtttttcacaataagctatcccatctcctccctactgaagcctctgatctgctatgattattaaaccctcatcttttagtgcaagaaacccagcaagctgaaagggaaatgcttttcagatttaaaaaacaaaaacaaaaacaaaaataaacttaatttcttttaggttgatgttgttatactaacttgccaatcagttaaacatgtatctgtcttttaaaaatatcttattacataagaacaaaagattttaagacatacagtttcaatcataaccaaatgtgtttattacttcgaattttccacagtaacttgaagccatctatgtacccatctccaattccatcgcttccccactaccaccagagataacggtggtcgtgaaatttgctttgttttatagtcttgctacatatatatgtattactaaaagagaaatagtcttgctctgcatgcttttgaacttcgtatagttggaatcatattgcatttattcttctgtgactgtttctttcaatcagcattatgttgctaagattcatccatgtctgtgactgcagcattatgtcatattccgtcatagaaataacccacaatttatttatgcatactactgttgatggatactagggtcgtttccagttttaattcttttcctattacaaacaaggttccttgtatacatgtaggagtgggattgctgggtcacagggcccatgtatgtgccctctggtatactctttggctcctttacactgctctactgtgtaccactgggagactgacctttgtagactgtgtgtgccaggcttccatttccaggtgacttccagctctctttggctgatggtgaaggattggaaactcagggaagacacaagagtgcttctcttcctctctttgtgtttcaggcagtatctttggcaacagctgcatatgctttgatgtcccccctccaaccagataggcccactatagctgcagcttccaatgaatgatctcataacctcattcactgaattcatgcaccctgccttcttctttcctcctcctccccattccttctcctcttcctcctccccatcctcctccttctctctctctctctctctctctctctccccttctctcccactcttcttctctcctctcccttcctctccctgtactttaagggtaatagtggcttcctgtggttgctaaactctgagtcactttgtcctccacagcttgtcaactctgttcttctctcatttgtttcaattctataatttaagctttctgatttaaatatcaaatgactttttgtgtctgcttagattctgactgacatgatgtatttctaagtttccaagattatgccaaattatttttaaaattggttacaccaatttaaattctcacgaacttaaaaattctgcttgctcccaaattctaacacttgacaatgtcaaacttaacttttggctactctgttgagtataaaattgtttctagctgtggatttactttgaattgcattaatgaaaaatgagtttgggcattttttcatggttccattggcaagttttaaatgcagacaattgtttagaatacattatttttatttaataaaactcattattaaatgtatattcctttaaggctgtactttgatttagtgtaagtagtacacaatttacctcagttttccgttttatgtattcactcatttaatttagcagatatgaattaagttctacaatatactatacagagtttaatgtgaaagtaagaaatcagaacatgttatggctaggataacttgggagcacagccttttgaaactggtttagtgttaggatacacatttttgtgtttacctctctttcccaccgccagtttcaccatcattcataagatcaatgactgtggtacattacaaatataatgtgaaattgtttacaagatttagtattgttcaatcattttgcaggcactatcatggaccttcagtgtcaataaaggattcagaggttccagaaaattctaggctatatcatgccttgagaagtcctatctaataaatatatagaccacttttagagtgtaaaggaattcgtaaaatgtgtcagcttaaaatattgaaatagcgagggtgacttttcctttccaaactgttgatgaagactgcagacagggataaacattagctctgtgtggacaggatagtgtctgttgtctgagattctggtcatactggtttaatacccataattgaaagagctctaagacatggctttgtggagaaagaaagatactacttgagagaaagcaagttcatatttccttttactaataagtgttcagattcctaaaatactgtaacagtaaaaagatattttgaaactttctaagaaagtgtgttctagggcggggcgcggtggctcactcctgtaatcccagcactttggggggccgaggcaggcggatcacgaggtcaggatttcgagaccagcctggccaacatagtgaaaccccgtctctactaaaaatgcacacacagaaaaattagccaggcatggcggcgggcacctggaatcccagctactcaggaggctgaggcaggagaatcgcttggcaggagaattgggaggcggaggttgcagtgagcccagatcacaccattgcactccagcccgggtgacagtgtgagactctatctaaaaaaaataaaagaaaaagaaattgcattctaggggtgaacatccacatgtacctgggatcaatccttccacagtcatatcttcacatcataattctaaccctaaatcatcaagaaaatattatgttagacataccatacataagaagggaaagagagctgtcctacataatcattttcatgtaaacctttcatccagaagttgaggtgttctgtcatccaaaggagtagctctcagctgtctggaaaacctttttgttcagaaggacatttgttgtgctttggtttaccttgggttttattgtgccgcgtgtgtgtgtgtgcaattctcattctattaaattattgtgtgattttgatacatttatgtcagggattagaaattttagaaatagattatttctggttttctgatcaatgtgtcctgtctatgtattttgtctttgtgcaaaggaataagactaaaacacaagttatatgcctgagtctacaactgagtgttgtaaaccaaaattccaaatgaaagaaagatatggggtggatggcaggattagagaattgaaagagtgaagaacaaaaggcttgcagacatcagtaaaatatgctttcttagttaaaaatagtaagaatgttttggaatattttacattaatttcgtttcccactttttctttacttttgcacaattaatgatttagtttttgagtttcaaatatttggccaagcttatctactgattgaattcaatttcttactggatgtgtgtactgcttttttgttgcattcatggcataaattttgtggacgcatttctacaaaaaccgtggattcagcatgttgcagagtactatggcaagaaaactgagtaacagactaagctgagacttggtagaaaatatctgttctcctacaaggcttgactctctactgttacttcaagaaaatattatgttaactatatgtgttatacttaagaaggcagaaggatactcactcctctgacgtggcgagatactcctcattacccccacggaaatactatctagattgtgaactcatccatagaatgactacatatgattcattttgtgatttccctaatatgtattgagtttaaactacattgaattccctggagtttgactagaaggttgattatccagtagagtttcttgtaagaaattcttatagcagtgaactattctttatggcagataaatcctacctgtgtatactgattttctttcttagtaccatagttatactcaggttactttttttttttttttttttttttgctcatatagacaagactacataatcctttttagaaagggccaatatcctatttggaataaaaacaaaacagttagatggtaccagggtcaccttaaattaacttatcagactatcaaccaaatcgaaatatgatttcagatgtaattaacccatttgcctagtgagatgcaaaggtgtgaggatttcttgaacacatctttctcttatgtagcaaatatcaacctcctgataccttttgtagtcagttcacataccatgacaatacatcctaaattttcaggtgtgatctaaccagcataggttcacataattggcatgacacggaatttttaaaatatcaactacctcaggaactttattcatgtgaatctggaagatcctttttggtatttgagccctttcatagattcagatgtcaaagtatttttagaatgggtctgtaaggcatcattattttgtaattataatcttattgattgacagcaaatgctgtgttccatgaaaatgttgcattgaagtgatcccggttagtgctaaagacagactgcttagatctaaagtctcatgagaagaaagaaagaacttaaaatcattttaaattcaccaatatgacgatacaggatctctcataaaatgctgaaaggttgtttttgctgccagacttttagcacttccgttttacgttcaaatgttgtaaaggttgattactcataagttaaaatgtttggtgcaaaatgtactttaaaaatattttcagtgttttttggaaattgtagacatttgattttgaaaagtaggccagaaatttggaagactacaagccatatgatggctgatatttcccatggaaaatataatatgcagctgtgctctgctgcatggtagaacaggagattaaaatatgagaaattataataccgtttgatgatgatattaatgtcactgaatcaaataaagtatgtgatatatcataagttaatagaacaacacttaattattgattagagcctacatcacattttaaattatcggcatgtttggtcttgcaaagggtcaagggtgactcgtagcaacagaactattctcctttcaaaaagttagcagaaagttaatatcaaattctatgaggtagagagggatttgggctgaggtaggtcaggaggaacgtaaagagatgtgtcatgtgtagatttgtgagctgtgggcacctgattttgtgtttaacagtatttacgaccaagataagtgaatgaagagctatgttcttatgaaccttaagtttattttgctaaaataagtaagaaaattcaaattcaaattaagctatatagtcttgcaaatttcaggtctctgaggggtgtgcattaataagtattcaaaagtattttgtcatttaattactattatatgaatttttatgtaattgaattattcttgaatgttgagaaactgtctttactaggctaaaaattcccttagtgatctcgttacccaattcctttgtgttccactctcagtgtctgaattgtcaccaatatgtggagtccaaattatgaaatacaaagctttaccagaattctgatgattttgaaggaagaaaattacagcaaattttgatcaattctctcctattagtgattaattcaatgaaccgcttgaatttcttatttcctcgtagaactgtatgtacatgaaggatagatacaatatttagtacaatctatagtgagatatgaagggaaggagattatgagaaaagaataaaactttattataaaaatgcttgttcataaagatttgacacaaaatcaatatgataagttttcagaaaatcaaacaatgaatttcgtatgaaacctcacattggcaaagcagttatgtgaataccaatattttttaaatctaaaacaaagcattttgaagtagtttcatgaataatgtactgaacctgtttcacgcaatgaaatgaacatcacagtgagaaaattattccacaattgtaaagttaagtgaagcttgcattataaggccaataatactcaatagggtattttctcatgaatttacactatagaatgtttttattctggaatttggatgatatcatagtcattcaacaaatacagagactaagtgatttttaaaatctttcaggaaattagttctttaatttcatctacatgtatgtaaaataaccaaacctatgtcttatgcatataatgtcattctaatatattgttcatgatcataatatttatatagaatccattttgcttggccgattgatttggcttggcctacaaattagtacagtccctctcaactttgacacttctgtgtaccatcagctccttcctggagtactgaaatagcatcctaactgctctctctcatgtagtcttgaccccatctataaatcctaatttcagcatttggagcaaccttttagaaagatcaattaaatcatctcacctcttcattaaaacgcctctcattctaccaagagtaaattccaaaccttttaaccttgacctacataactggaccatgcctccctcgcccatttcaattcagctttgctcttgtagctccaggcaagctagctctgtcttagttcttgcatgtaataagctttcaagtccctcggtgtctacttatttactgttccctctgtattagtccattctggcattgctgtaaagaaatacctgacactggataatttataaagaaaagacgtttagttggttcacggttctgcaggctgttcaggaagcatagcagcttctgcttctggggcggcctcaggaagcttctaatcatggcagaaggcagacggggagcgaggtgactcagacggtgggagcaagggcaagagagacagcaagtggggaggtgctgcacacttttaaacaaccagatctcgtgagagcccactatcgcgagaacagcatcaaggggatggtgctacaccattaatgagaaacaccgtgatccaatcacctgccaccaggccccacctctaacattagggattacaattcaacatgagatttcgtggggacatgaatttaaaccatatcactatctgactggaatgtgctttgctcctgcttctacttccgttttctgagcaatcagacagttattcattaactcattcattcattcactcactcatttgttcatttatgtattaaattattcagtgattctcaactctgggtggttttgccgtccaggggttatttcaccatgtccggagagattcctagtggcataactaaaagaagagatgtttgctactggtgtctagtgggtagagaccagggatgttgctaaacatgtaataatgttcaggtcaacccaccataataaagaatcatcttgtgcaaaatctcagtagcaccaagattgagaatctctgcaatacgtcaacaacccttctaggtgccaggaatatgacagtgaaccaaatgaatatggtctaaactttcacaaactaatccattaaggagaagatagtcaataagctggctaacaaacaattaaatgtatactttcaaattatgttgggtgctctcatggacaaggggacaagagagtggccagtgaaacctaatttagagcaggtggtgttgggggaggtggtgtttatgctaagacccaaagaatgaaagaaagactcagccccaacttatatatatagtaaacatttattgaatatcaatagcaaaaagttgcatttttctcaaccatgtctttttatggtaactggaaattgttcaaattattttttagaatcttttaatcatagattctttgctaaggggattagtctagcatttttctcttgtgagcaattaagttctcaccaagttagtgaatcctatgtcttatgtacttcctacttattactatgaaattatctaaaaaatgctcatagggttcctaatgtagttgaaaagcaaactgttgctgcatctctaatcagtaacaaaacttgtatttctgtcgcaaaataatgtaaaattttatagtactttttacatatttatttaaaacaattttaagtaagattgtttctttgtggaaggtcatatggtcccaatatagggatgtgtacagaaatacatatatacatacaacaacacaatgttaaacctagcaaaagagtggagtctctttcttttatttttcttactttttgagcaacgagacaagcaacatattatgcctagtcacttgaatcatacaccattaaaacattatgggctgagtgcagtggctcatgcctgtaatcccagcactttggaaggccaaggcaggtggattacctgaggtcaggagttcaagaccagcctggccaacatggtgaaaccctgtctctaccaaaaatacaaaaattagccgggcgtgtggtggtggatgcctgtaatcccagctacttgggaggctgaggcaggagaattgcttgagcccgggaggcggaggttgcagtgagcagagatccgccattgcactccagcctgggtgacagagcgagactccatctccaaaaaaagaaaagaaaatatgaaaagaaccatttttaatgtcaactactgctttgatgctaatgtctgtcagttcagtgtctatgacttaccctttattctgctcaaaaccttcttgaattttccatttgaatatcccacaggctcttgaccccacttatccaaaattaaacctatcttcctctctactacacctcttcttataatctttctcttgctatttctaaacatttagtgggccaaataaataccctaggagacatgacttgaaaggggtatgaagtttagataatgttcggcttcttgatctgatactggttaaatgggtgcattacatttgtgaaaacttattgagtcacttatgacttacagattttctctatatattttatattttaagaaaaaagattacatataaattctagaagccaagctacacctttccctcttattcatccagcacatttactgagacagctagattttcataatgactgtccattgttgaatatttgctatatctttgatattgttatccattattaacttccttacctggtttgacagttgaaaatttctgtggtgcagctattattatttccatttcacatatgagcaaaaagagacttagagtggttaagtaacttgtctaagttcacacaacaacaaagtggcaggagtagagtttgaattcgagtcaatatttataatcactatgatatcttgcttctcgtgttccagtcgcattaaaactatgaatgccactcccactccttatccatccttactacctggcttcactttagatcttcaggtcttctttcctatattataatgataatatcataagaaatccagtgcagtttagtctattccaaaatcagtctaaatactgccaggattagtgttcattccacaatataaatctgattgtgtagtttacttaaaatccattaacacagccgttagcaaccttagctacatgtgaaaatcaccaggctccacccaagataaattaaatcagaatctctgggtatgagggactgggagtgagcattttaagaaagctccctgggtaactgtaatgctcagctaggcttggaaaccaatgctttaacgtttccctacagcttttattataaaaataaacccctcagcattgcacaaaatgccctttgtaatttggtttttgccttcctctacctcgcctcctctgctgtaattcccttcttctcccactttttccccaccctacctacatacatttcattgcaattattcaaaagtctttgtttcttctgaagagttatgatttttataccatacccttacacataccagtcttcccctctaaatgcttagttacattatctttgtacttaatccttttagttgctgataataaatgaaaatttctttttagtttctttttttttttttttttttttgagactgagtctcactctgtcgcccaggctgggctgcaacctgggctgcaacctccgcctcccgggttcaagggattctcttgcctcagcctcctgagtagctgggactacaggcatgagccaccaagcccagctaatttttgtatttttagtagagatggggtttcatcatgttggccaggctggtctcaaactcctgacctcgggtgatccacccgccttggcctcccaaagtgctgggattacaggtgtgaaccaccgcacctggccaaatttctttatagtttcttgacttgtttttaatttagaaaatttcccacgtatatagacaccatacaatttataatgtaaagctgttttcctatatcaatcatgttttaccttttttctctttctcctatatatgctgcttcctggaagatctaggagctgacaagtgtctttttatcttgctttgcaaatctaatcttttgccatttctttttatagaaatgaaagcttgtatcatgcatactaaagatggcttcttctttgggctgtagggccatttaatgagttatattgaactgaatgctttataagagttcaaattagtacattgggatactcctatgccagggatggattaatatatctgtccacatatatacacaaaaatgtgtgttgctaatttccaaattagagaatacttattttgaattatcagtatctatgacatattttgcatgtggtatatatttggttaattaaactgagttaccacttgttttatcaaaatttggtgtctttctaaatatatcatgaatatttttcttctaatgcacctcgctttctgctggaactatagaaacactttgtaaatttttacttgtgaccactcgaacatttacaggacattttacctgaaaattttttctgagtcagtgaagaaaatgtccatgtttctgcgtgtgtgtgtgtgtgtgtgtgtgtgtgtgtgtgtgtgtttgtgtgtgtgtgatgcttgcttatgaggaatttattttggctatggttctttattttgctattgcactcttaacattcgtatgatatgtattattaccctataaatacttacacaatatattcttacaaaaattaatacaaagattggccaaaatgtaatagcatatgtttttgtaaatagaatatccatatacagtcataataaaactgaagagcgattttatacttttccataaagccaaagattaagggtgtaatcactgcttataatttactaggaaactataaaacagataaaagtagatgaaaggatattacaaatatctcaataagtcgtcctccgcaactgaccccttgctttacacatgttcagacactctatactaaactctgtttatttttctattttataattttctatatgatcgtaattcagcgttttcctataatattattagtagtgctaccaacagatattacattttatgaaaaattttaaaaagggcacatgttgcataaaactaggttttgaaacagctgcttataatgctgatatttagcacatgactaggtggaatatggactttttaatgaatattttttcaaagttaggtaatttctcatcagtcagtttcaaaagcaaagttaaaatttgtgtttcaaaaaactgggtatgtttgaaaattgtatttaataatggattttgagagttctcaatagcaaattgcttggctgactgtagtttaagaagtaataattttgaagagaagttgaatgcaggtactttcaaagtgttgaaatttttaaagaagaaaattaaccttttcagactgtacacttgttcatcttttatattcttttccctttaaaaaagaattgtagtaagaagggagattaccttctgtcattgatacaaattttccacagtataaatgctgtttatcacatttgtataatatacacttcctatcaattttaaaaattacatgttactactatttaactctgacttaattattttaaatataaaataattcattcttttataaataatcaaaactatagttttacttttctttcaaaatataccactgactacattacagattagattttttttagtataccaaacatattttcatcttttggagttattggaagagtagctgcttactgccttacattttagatttctctatataacaagcattttcatcattttggcttattcgagtaattcttaataaataataatacaatatttacaaatgagatgtcatttgcaattttaacacttcataattttaacaaaatatctttactttgagttttttactttccttttggtgtgacattttgacctccaatgtgatcttcatttaaaggaaatatcaacgaaaattccttttttttcatttgctatagatgtacatataagatttacatgtgtaaggaatatagagcaataatgaattgagctattcctcataatcacttcacttaagaaatagggggctgggtgtggtggcttgtgcttgtaatcccagagttttgggaggctgaggtggtaggattgcttgtgtccaggagtttgagtccagcctaaccaacatatcaagacattaagtctatgaaaaaattaaaaaattatctgggcatagtggcatgcacctatagtcctagctactcaggaggctgaggcagttgaatggcttgagcccagaaattcaaggttagactgagagctatgatagtgccactaaacttcagcctgggaaacagagtgagggcccttctcttaaagaaaaattgactagaatatgactaatactctagaagccctcctccacatgccacccttcccaaatgcaccactattctctcttcccaattttcatttttgtatttattattcctattcataccaacacaattttaccagatgtgtatgtattttcagcaaatatttttagtttattatgcacttaattgacactatggaagaacagcttttaagatattattccaacttagggaattttaaggaaataagacctttgtatataaaaagttaaataggaataccgatttgcttttgattagtgttaaatcacataagtttaaatttgtaggagatcatagagatcagaaagcccagtggttcacaaactttcttttttttatcaacaaaacctcttttaaaaatatatagcataaggaagacggaaccataaaactgaaattacagcagctcaactgaattgtgagtttcaactgaactcaatttcaaacccacaaataagtcaaactcttactttactgagaatatatttggaccacacagagtttaaaaaacatgtttaaatttatttagcttatttataccagaaccaatataagaatccataacattctgcattagaattaagtacaaacactttttctttctttctttttctttttctttcttttttttttttttttgagacggagtcttgctctgttgtccaggctggagtgcagtgacgcgatctcggctcactgcaacctctgcctcccaggttcaagtgattcttctgcctcagcctcctgagtagctgggactacaggcacgtgccaccacgaccagctaatttttgtatttttagtagcgacggggtttcaccatgttggtcaggatggtctcgatctcttgatctcgtgatccgcccgcctcagcctcccaaagtgctgtgattgcaggcgtgagccaccgcacccggccgtagaattaagtacaaacactttctatgatattatactaaattaaaaacaggaactcaaaatgatacaaactgaactgaaataaaataaaataatacagtgaatggagtccacaattaaaatacctgcaaggacctgaaagggaatggaaataggtgaagcaaagatctaaatgcatacggacattgtgtaaattggaaagaatactggcaaatggcacgcctgtgcccagtctaaaatgggcaactgctaatcaattcagtctagcagtgtccatgtcagaatgtagagctatttttggccatatattttatttttcaagaggaacttaagaatctggagttgtatgtaaaacatcccagtgcactatatatttgcctcataagttgagcacttttttttatgtgtgcatgttgtctactggtgaatcccaagcacttggaacagtgcctgatatatagtaggcagtgatgtatatttggtgggtaactggaaaaaggttttccaattaaaaattctgtgcaagcctgaggtaggagttgggcaggacttatttcccattcccagaggataaagtgaagaaactggcaggtaccagcaggcagcgaccaacggaagtgagaaaaacagcagaaaccagcagatggcaacaaaagtgatccccagcagccctcattgcatattagcagaagccactcccaccagcaccatgacagtttacaaaggacatggcaataacccagaagttaccacccctttcctagaaagttctaaataacctgtctctcaatttgcattaatctgccacttaatttacatgtaattgaaagtgggtataaatggatataaatacagtagccagcagcccataccctgccaactttggaggcactgcctatgagttgtccctatttcacaaagcgcagtaatgttcactaaaacatagctgtttaacgccactggctcgcccttgaattctttcctaggcaaagccaagaatcctcccaggccaagccctgattttggggcttaacctgtcctgtatcaaactagccaaatgtatctcaggcctgaattagatcaatggctaccagttcaaatcttttgttttagatattagagaggcaggaagtgactctctactgtgtagcatgatactcagagcccaggaacttcttcagaatcccagtttgacttccaaaacgccagtgtcttgcttttatttactcttgtgggtggcagtaagggaagggagcatatctccttagcaaaacatctcatcagaacacggtccatagcacaaattattaattaaagacttacgtggaggctcaaatatagagccaaagcataaccatttaacaattatccttcaaagcaattttattcttggcttttggtggaaaaaactcttaaaaataaaatgataattctacatatgggatttgtgatgctatttagcaaggatatgctttattgcctgacatcccctttattttggcagaatactatgagattctcattacgtttccatttgctgcggaaagtggagaaaagttcagagggggaagactaattaaaaaaatggttgtctactaatccattgaactaaggcttcttaacagtcatgctcttcttaatagtatgaacacacattttgtattgattgcagagaataaagaaaaagaaatgacttgttttgaacttcaaaatggaaaaaatgaatacaaaatccagataagcctttgggcataccaactttttcgacttgtattatataacaacagttggcaaatgatttcaagttgctaaagcatagaaaatgatatttatttgatgaaagctaataaatcagacagaacaattaatggataatttggattgaacaagtatgaaagattccaccaataagaaccctcctacctaaaactatgaggtttttaaatgaaagactctcctaatgtcatagattttctctacctgtgctttatctgaaaataaaaatcacagcttttcccttcacctcttcattctctactcctccttatatttcccctttccttcttccttccttctccttcctttactctttgttctttttattcctgtttgttctgattacctgtgatgttttctaaaaacattaaaattttggtcaccattaatattttttacaatgaattaagaaatttatctcagaaactggatttgaaccaaagccttgttttgaacttctaataagtagactgaggaacaagcacgattttaagggcatatttaataggcaaaataaaaaaaacgcataaaatgcccagtcgttgatgaaaaaaatatatttttgtaattgctgttattcaggtgcttgaaggcccatgttaaagtatcactggagaagataaaaagcatacttcctcaatgtgaaaaccctcaaaagaaagggctataaacactttgtcctgaatatttgttgtttcaattgctgacgtttaacttttcatctgacagcaattcaagttctgcgtaccacagtgttgttgaatctttgaatctgaaaaatattttccttgcagctgtgataataatgtatctcctgataatgcatttaatgtggcaaagacacttttcttaaacacagtgaaaactaagtgttcattttgtcattgtaaaatgagacatgtttagttgctccaaattttaacttgggtaaccttgagacatagttgcacatttaacatcctatattttgcttgtcttgcagtcaagtgaattatcttagttactggagtgttacgtgacaccaattgttttgttaccactgctttaaaaatagctctatccctagaccccatcagtagtgtgtcttttagggccccgatttttttctaatctataggttagccctcaaggcaacgtggcctctttctgtttacttctcattattcctgtaattccaattctacatgtgactctttgctttattttaaaacagttgtgcattgctgatgagccttgaagtcaccaggggtggctggtgtcaatagtgagtctgtacatggctatttttatccataaagcagtttactttctgtatgatgaaaggcgttaaagtaaaacctgcctcctattataccctaggggtgtaatcaagagggatttgatcatagcataccaattaagcaggctacagcagactgctctgggttgtactaaggagtagggtgttctccacagatttttgaaccctttattgcaaaagcatcagggcacagcacatctaattcttttcatcgcacagctgtgtacataaacctctgtatacagtttctgctcagaggctgtgctcttagatttaatttttcttataagtcattacagccgtgatcattcatttaaacctcggcaagataagcattactagttcccagtaaactagatgatctcttcctctagactgtattttctcttatgaacaattataagattacaagactagcaatgttgcttatttacactacactacacacacacacacacacacacacacacacacgttcattccaagccagcagccagctcagcatccttgaaagctctcaacctcagccgaatatataaatatcagaattctctctaccaccctcaattagaaaatgttccagttctgcttttaaacttccactccaattcttcttgctaaggcctggaagcctcaaggtttcttgtattgccttatatacacctggattattcctctctgttgaaaactatgtcccattggaatgggagtgtctgaccagctggtgcccaagaatgctctcagaaaacgatcttccacaagccagagccaaaacccaaacccttgacccttatcaaccttgacgcccaaaactccaggtgtggattagcacagtaacccgcaaacccactcctacacgaaggaagatttttctagaacaactacagctctccttttatatttttgggtaattcagttatgatgaactgaaccagaagtataaagtatttgctcagttcagttcttaatctttgtcatggtattacaatactaaaccacttgctttgtcactttcatatagctcataaaagaaaatattactgtataaaatagattctgtagtccttcacttgttgttatggactgactattcgtgtttgccccaaattcatatgctgaagccctaacccccaatgggacgatatttggagatggaacctttgggaattaattagggtaagataagcacatgcaggtggggctctgatccggtggcccgtgtaaagaaaacaccagagagcttgctcttgctttgccatgtgaggacacaggagaaggttgttgtttacatatcaggaggagagccctctccagaacttgaacacgctggaacactgacctcggacttaaagcctccagaactgtgagaaaataaatttctgttgtttaagctgcccagtctatggtatcttgttacagcaggctgaaatgagtaagacacttgtattgtccctgcggttgacatctgactctgtaaaaacacccatgcatacacacacgtacacacaaaacaacaacataaccagtaagataggtaatcaagtatatggtaaatgcacctgattgcaataatgtgcgcatacccttagaatgaccctgtactgcagacacacctgaatgtgttttccgagctacggaatctgggagtagcccagcaagagagcccttccttgtctatgaggaacatctgagccccaagtgcatcccgtggaacacgggccatacatacagcggattgaggccccgagttttgggttggatgaaggttgccaggtgaacgtcattaagggcagagggttaagtaaaaatgctatataaactgcatgctgcccgcaagcagcgttggtttgcccgctcatcccaccgccgccatcactaccactgtgctgcgaggctatcttgtccagtctgccaccactggatcgtttctacaggtaaggcacttctcctgtccagcccaccactactgaattccctcccctgtatgtaaacctctaataaaacccaatgcctcgtttgctggctatgggtttcttcctcagtctcttgaacctgatgccttcgctattgagggttataggggttcagtacaacatcatgatgtgaacaaacgcgtttatttgggcagatgtattggtcagctctcaaaacaataatatcaagtaataatcattacctccaacttaatggttttaaatagcattaattctcatggtcatgcggggtttggctgacctaagttgatctagatttggttctgcatcaggctggtagttgctaggcttggctttcagcggcaggtttggtttggatttctttgatgtgtcacgtccagaggcacacactggaatggcaccggccacccagtgcatgttttcataggttgtcactagatagcaagcccaaacatgccagcccatctcaaggctctgctcctgtcatgttttcttaacaccccgttgaccaaaggctatcacatttcccaccataggctagatatgccatcctattaagtaggaatgagaaagtggggaccaataaatcaacctacagtaggaaaagtaggggattatttagtagcacaaacagatgagtttcagtgggcttgctgcttttttgtggatatggaagaaatacctaaaaaaaaaaatttccagctccactacaatatttaagaaaaaacttaggtgtgttcatagtttactactttgcttaataaccccactgtttatcacagcaaatttaatcacctctgaggggttttaatggctttgataagacaaagagtaaattactgaggaggaagacggtcactttcacatcctgagagatgctaactgtgcaaggtaattcacatatatcttgtaaacatgtttgcaaacatatataggagataggtggtattctcattttttaaggaaagaaatggaagacatgagagaatgagtaatatgtttaagaggacacagctggaaactggtataatctggctctaaatacgggcttttgtgttacattgaacagagataaattcagcttatgttaaggaagcatggggtaaaaaggtcaagaaactgaacaactgaataaccaaataagtaggcgaaaccatttggttactcagttgtctgaccaaccgaataatcaaaacaaaaatgtcacattagaaaactacgatcagtgtaattttatgaataattgaactattgagaccatagtgtagcagctgatctatcacgtcatgggattccatcattcattctcatgaattaactactctcagtccttgcttttagcattacctctactccctaatgatacatgatttttactctaacataaacttcccaggagaaaatgtctgataaatatcataaaatcatgaaaatatctgataaagtcatcatcctgcatcatgtgtgggagacttaagtttgtaactcttcccattcctttaagttggttttcagccttgcttacacgatcattgtggccagagagacagaatgtgccaagcgtgtaggcctgagctgggaaacaatgtcaataagtaatacagtataggggatgagaagtttgccaaataatacttggtgtgtaatgttatgaaagaaagggggcattagaggccgggtggctcacgcctgtaatcccagcacttcgggaggctgaggcgggtggatcacgaggtctaagagatcaagaccatcctggccaacatggtgaaaccccgtctctactacaaatacaaaaaaaaattagccgggtgtggtggcaggtgcctgtaatcccagctatttgggaggccgaggcatgacaatcgcttgaacccaggaggcagaggttgcagtgagccgagatcgcaccgttgcgctccagcctgggcaaaaagagtagaactctgtctcaaagaaacaaaaaacaaaaaacgaaaacaaacaaaacaacatggcgtggggggcatcagaaacacacaatggtacagatttaaaagctcctcgggtgatgctaatgtgtagccagggctgaaaacctaaaagaagaatgtgcagtaatgttgccagtactggaaggaagtgtctgagttttgtctagtgactgacagaaggctatgaaactgtaacagttgtaaggggttgagggaaagccgaggccagatcatgtggatcatgtgcaaattgtaggtaaaatgtaaagctgtgagttctgtggcctcactgaggaagcatttctctgcttttcaggaagtaacttggagttgagtgctctatgatttccaagttgtcagctaacacattgaataactgatgaattatggttctgtggccttcatttctgtgtcacgtggctatactgttcattggcatatgcaggcagtaacccccaaactatgacgcgagaggatggcaggattccaggtctgaagagaaaaaatgattaggctggggaagaatgatttgaggaacctcaaatcagactatggcagcaactactaggtgtagggcttcatgccatccagccttggagttgtcagttttctattaatctttgctaacaataaaatactaatgggtacataatgtagtgatttacagatgatagactctccttatgttttcattttgtctcaacagagtccagcatatttcatccaaattttactgatcagagaattgaggtacagacagaccatgaaggtcatgacagttggaaagtgttggagtagaataaggaagcctgatttttctcatttgtcctacatcgctttattagattgtcttctccagccttacctccccgccttataattcttgattttcatgaaacctattaaagggaaagaaaaggaaaactagaaaatttaatttagatcacttttaaaaatcactttgcatcttggactgttgtcataagttataggattaaatcctaatgattctaatgttgttaggccatcttaatttatatgatccacttacctctcagtcttctctcactggctcactcacctgccctctgtatatgaggggattgagaaaagtctgtttttcattatgtgtagatacacagactggtgtgtatgtagcaggaataaatgttcgcaaaactcagatgtggaagaagtaactctgaatttttgccctatttttgaactgtactccaggccagtgctgtccaaaagaaatataagctatatatgtaatttaaactttttgagtagccactttaaaaagtgaaaataaacaggtgacattaatgttttatttagctaaaatatttcaacatgtaatcaaaaaagacttaatgagacattttacgttagtgaaaagaatgtactaaatcattaaggttggaggatattttacatttacagcacatctgaattcagttgccatattttcatgggttaaagtaaacttgttctcccaaaccaatgaagttatggttaatggaagaatattaaaaactgtttgttttcaatataaataaaattgaagcaaaaataaagcaaaatgaaaatttggcttcctcagttatgctagtcccatttcaaatgttcagtagccacatataactagtggctatcttactggacaacataaccccagatcatgataaaacgttctgatttcccgaatttcttttttttagacaatctgggatgtttcgccttcttaccaaagaaacaaaaaggtgctggtactttttgtttgcttgtttttcagcagttgccattgaaatgtgtttcttttggagttggataggaaaaacctagattcttcctccaaggtgtagtctcaactgtgccccaggcatcactgtttatgatggattaagggtgtggcttttcccagataatgagtccccctcccccaccccccacaggccttaatatctacagctcctgtcaatagactggcctttccttccccgcgaaaagtttgagtcctttaagaatctaggtctaaggttaatttcaacgaaaggtttattttctctttctgcgaggacctatggaactacccagaacatataaagcagtccacaaggctcttcaacagcttcgtaaccgggcactgctagttcagaaactcactgacttctgaatgtccatttcacatttgcaggctgcttctctgagtcctgagctcttgtctcaagatgacttggctcttaattgttgtctgatttattaccggtttgctttgcagtttaggtgctggacaatgattcttagaaatccccacataaggatctacatgcagtggcagtgaatctcaataactgccttttcttgaatctgaacttaatttatatataaagcctactttccggtagatcctgcatatttcatctcagccaatttaggactgagatgccccccctttctctggggttttgtcttaaatttctggaggggacctgattgtcacgcccctccgagtgaagagaccaccaaacaggctttgtgtgagcaacaaggctgtttatttcacctgggtgcaggtgggctgagtctgaaaaaggagtcagccaagggtggtgggattatcattagttcttacaggttttgggataggcggtggagttaggagcgatgttttgcgagcagggggtggatctcacaaagtacattctcaagggtggggagaatgacaaagaaccttcttaagggtgggggagattacaaagtacattgatcagttagggtggggcagaaacaaatcacaatggtggaatgtcatcagttaaggctattttcactcttttgtggatcttcagttgcttcaggccatctggatgtataagggcaggtcacaggggatatgatggcttagctcagagtcctgacactgatacagtgccaggatttgaaggcgggtgtggcttacctgatttcatgtacaattcatcccatagggaccttgttccttggcctcaagttgtaggccctttcatatctctgtacggtcaagaaacatggtggttcccttgtcattcttcatcctccaaaaacccattgagcactgtgtttgctggaggcatgtgggaaattattctactgtaccctatatcctgctgaagtgcctgggtactgggtggctagctcatgtccatttgctaagacacatgctcacgattcttgcctgggtctgacataactttggagtcttgttgcattcctgggctggactctggaatgggacccaattacttctgcacctggatacccccaaccttctctgttgtggtggcggttctttcaccatcccctcctctcaggaacacactcttgtttctactttacattctccatccagtccaggaaaatagtatctaggctcagagacggagaaaatagtgtctatatttcacatttttttccaaaaaaaaaaattataattttccgtgcctggacttgagaatttgaaaactccaaaatcctccaggttcaaccacattgttcccaattacaggattttcttattaaagttgaatagtgttccattgtgtgtatattccacatttttgaatccgttcatctgttgatggttacttaggttgattccatatcttgtctaatgtgaatactgccacaataaacacgggtgtgcagatatctacttgatatactgatgtcatttccttaggtatgtacccagtagtgagattgctggattgtatggtagttctatttttatttttttttgaagaacttcctgctgttttccataatggctgtacctatttatgttcccattaagggtccaaggtttccctcttttccatattctcaccaacactagttatcctttgtctttttgagaatagccattctgacaggtgtggggtgatagcatattgttttaatttgcagttacctgactaatgataagcattttgtcatatacctgttgtccatttgtttcccttaagacatgctcgttgagacatggacacggggaggggaacatgacagaccggagcctgtgggggtgggggcgtagggagcaaggggagggagagcattaggacaaatacctaatgcacacaggacttaaaacctagatgacgggttgatagatgcagcaaaccaccatggcacatgtatacctatgtaagaagcctgcacgttctgcacatgtatcccagaacttaaaaaaaataaaaaataaaaattcagttccttaatcacagttgccactgtgattttactttgtcatattttaaaagcttttttatttcaaaaaaaaagtctgttgaggtcctttgcccatatttaattgggttgttgtattgctattgagtttaaggtttcttatatatttttggatattaatcagagtgaagggacaactcatggagcaggagaaaatatttgtataccatatacctgaaaagggattatttccttggctgtgcagaagctgtttaggttgatgcaacttcatttgtctatttttatttttgttgcctatgctcttgggttcatatccaaaaaatccttgcccagaccaatgtcataagcttttagttgatgtttttttttttttttttttttttttttttttgagacagtcttgctttgtcacccaggctggaatgcaatggtgcggtctaggctcacagcaacctccaccttccgggctccagtgattctcctgcctcagcctcctgagtagctgggactacaggcgctcaccacaacgaccggctaatttttgtatttttagtagagacggggtttcgccatgtttgccaggctggtctcaaacccctgacctcatgatctgcccgcctcaacctcccaaagtactgggattacaggcatgagccacctctcatagtccatgttttcttctagtagttttagtttcaggttttacctgtaagtctttaatccattttgagtcgattcttgtatataacagataagggtccaattttctttttatttatttattttttttgagatggattcttgctctgtcatccaggctggagtgcagtgatgggatctcggctcactgcaagctccgcctcccgggttcacaccattctcctgcctcagcctcccaagtagctgggactacaggctcctgtcagcacgcccggctaattttttgtatttttagtagagacggggtttcaccgtgttagccaggatggtctcgatctcctgacctcgtgatctgcccgcctcagcctcccaaagtgctgggattacaggtgtgagccaccatgcccagctgtaagggtccaattattaatattcccaattgaatggaagaagtaaaaggaaacaaaattaaccatattctcacttaaagtcattgttatcattttggcatatttcattgggttcctttttacccgaaatgagggttttctgctatttatttagatgtgatcgtgctatatttatgacttttcacccttttttactatcacataagtgattttaggttattatagacacactttaaatgttcacataatgaccacttattctaaagttaggcatttagttttttatttttgttgttctaaataacccagtagaccattttgtttccttttagacagcttccagcgcatgaaattattaggtcaaaggatattacctttttttttgagacggagtcttgctctgtcgcccaggctggagtgcagtggcgcgatctcggctcactgcaagcttcgcctcctgggttcacgccattctcctgcctcagcctcccgagtagctgggaccacaggcgcctgccaccacgcctggctaactttttgtatttttagtagagacggggtttcaccgtgttcgccaggatggtctcgatctcctgaccttgtaatcttcccacctcggcctcccaaagtgctgggattacaggcttgagccaccgtgcccagccaggatattaacattttttaaagggtctttatatgtatcgcaaaaatacttagcaaaattattattattattattttttaccagtttacactgcccaccaagaagctataaggacacctaaattgtcacataaaactgtgtatggataaatatctctattttataaaccacttggtataaccaaaatcctgcttttgagatattaaattttgaagctaacattcttagcatgtttttaaaataatactgacttcatgagctaatacccataatgataaaatgattttatattccaggaaagctgccatgtgggattgaatgttttatatatgatacacttttatctacatatgttgttatacagtcattggtacctttttattagatgaatttatttcatattcagtttccactgaattgtattcagcttgactacaaattagtcaagcagaataagaatgtgagttttattgtgactaatatatatttggagtctagatttggagagacaaggggtgagtaaaactgtgtgcctactacctgaaaggaaaggttttttttttttttttttttttccccctcaagggaaacaattacggagactgcccaggcatttaatattttattgaaatattctaaaccctcaaatttcgcttctacattttatgtgatgcatcagaaaaacactattttatttgttttataattctccaatagggaaatttcaacacattgtaagtttctttatttaacaacatcatctagcttttaataactgactttcatacacatttttaaaagcaggctaatcgttatagcttaatatatttttcatgagatttagtgataacatgatcacttataccagtagtttatctcctgaatcattttaaaaagtaatgtgcatgttttctttatatttatatacaattgggaagcttaatatttatgaaaatatgattgacttttttttgtcatttctcttcaaagccttaggctttgcagttatcagtagtgcagttccaagatgcaaagtcataaacttacctttcattctctttagtaggcttaatattttgaatctagccataggaagcagcctgaaacctctaatcgaaatcaaagataacaccacaggggtacaatatctctaatttgtcttggaatgatgcggtagcttcccttgactgctgtgattaaattcattctggtttgttcagttaatgagattagcacatcttaacccataggaaatattgtctttatgggcctatgactctgaacagattagcatcatgatcagaaaaataatttttaataaatgattacgtgtgagtggtgctaggctaggatccctacaaatctggcaagagcatattccttgaccttcagcattatatgactttataagacacagcattttctcaggcatgggtataaatacagttaaatatgtactataaaactaaagaacagcctgaaatttaagaactacaagaatttgtgcttgtcattaagctggagataaagttaacatcctgagaagatgtaaaggcgacagtgatacacttctccttgtttggtaggatcatttccacacttgtctgtacttggaattgtaaggtgatgagtcccttaatgatttcttattgcaagtttgaacctagtgtatttcatggtaatagactaaggggaatgagtatatgaaatgagttccagtgtattgatgaaacttagagttgcgtagagtggagcatagcttagtagaaacttgagcaagttactgtagcacatggtcctggttccaattccagcaacatctgttagttttaggacttggtgcaacttgttcaaattttctgtcagactctccattggtttaaaaaataaaattcaaaatattgacaaatattgccttcctgaattttttggtgaatattaagttagatgatgtatataaagtgcctggcccatagtaagggctcaataaaagtagctgttggtaccgcttttaactaattgttgttaaattgattggttaattatatatttccctgccacttaactgtcactcaacagcttttcctcatttcctgcctacctgattggaaatcattatgttgaatatgtctagaattatcactgggcctgctgtattccctgggtggtatgtttgtataggttgaaccactaaagaaaatcttttcggatgagttactttcctatgtcaccctactatttcctagtgggaactttaagttccttcagtctggggtcaagactagtcttagtataggggacattgggaatattgaggatggcatgtttaagtaacattgtatgtattggtcaagaaaaaacaggcaagggatagagtacatcaaaaccagaaaacctatgtacttacctttccatttctgtctttattagatatgttgagtttatttcaagtgcctctatagaacatctacagaacattaatattaagaatatcatgaaaagggatacatttttaagagcctaaattttggataaaatggaagtcattttcttttttttttttttttttttttttttttgaaacagagtcttgctctgtcacccaggctggagtgcagtggcatgatctcggctcactgcaacctctgcctcccgggttcacgccattctcctgcctcagcctcccaagtagctgggactacaggtgcccgccaccatgcccggctaattttttgtatttttagtagagacggggtttcaccgtgttagccagggtggtctcgaactcctgacctcgtgatccacctggctcggcctcccaaagtgcggggattacaggcgtgagccaccgcgcctggccatggaagccattttctaacaacaaatttaatttgtgaaaagctggtagcatgttaactctagaatgacaattttttaaaaggaaaattccaaagttaaagggaaaaaatattggggtagtgccagctagtatcaggatttatactttaaaaatgcataagaaagaagcaattaccagtgtccaaataagaaatgagagtaatagaaaactcagatttcattgtattataaatttaataaataagttacacaattgccgttcagtgcctgaaattgatttttctttttttgaggtcaaacttcaaccatgtatatgaaatgtaagagcaactttctaagcagaattaccctttctgatttccttgggttccttttggttctttaatctgtatgactaagagtgtggattggctgacattatgagatgcaattaatttacatgcttaagttaggactataccatcctgtttccatccattcttgatcacaagcatattacaaatgctgtgctggattatctttactattaagacatactgcagaaagccctgcaggtaaagaaaacaatctagggcttaccttagaggcaggaagaattgcatgttaagaaagctgcatacactctggctttttgctctttgagtttagctcaatgtcttcctaaactttggtgtgcaggaggtgactacgcagtatttaaaatctaatccatattatgtgtatagtatggatggtatagcaattttccaggtggatttttgacaatattttattttttactattcatgttgactttgaaaaataactacagggctagatttgattcaactgtccatggttagaatttttaaaaaagtttttgactctaatacaactgagttccatctacagaaagaatgcacatatggatacggctgtccagaagatcaaatatccttgtactgaagtatatctatatttagtcattattttataaaagtagtagaaaacaatagtggaatataatatgtggtctttggaagaatgagaaatcatccttacccattaaacacagacccaacacttaatgtatttccattttgatagtgacaagttttgggtttgggatgatgtgtcagccagggtcagttaacagacagaaaccacttgagtgactgtagcagaaaataatgtaacaagaggaattgggatctaggtattgaaaaattgacaaagagaagaggtagcaagtgcacaaagtagctaccgctcctagggctgggaagacaaaaggttagaattactaacacttagaacccttgaggaaggactctacaaagctgagctcaggtctgagtagggggctgctacgtggctggtgctaccctctctgggatagcaggaagggcccaatgggactgaggcccggacctctgccagccaggtggtgctggtatttctgcagcaggggcgatgaagctgattctctaagcttttgaaaaacaaaacacaagctaaattgaatagcttgttactaaaaagtgctgctgcaggcatgaagaagcacgtctagggaactgctaataaggacagtaagtgcatgggaagctagtgtgaatgagtaaatcctttgtccctcctccaggcttgcagtctccctctattgctccctacctttagattctgagagtcagtcagtaaagccagaagtacggtttgcagagtctttgcctcagcgttgcaaagtagggtttagaagggtgtgttggtatggctctgaggaagataaaatctctaaccagcatgagtgctaatatgtctaataagatatatggaaaataattattaagtatttgactgaatttcaaggattaaaaagcaatacttaaggcaacaaaaacatcttatatttccattaaagcataatttttcttacagctccttcacattggcaaaattagtttgccctcttgaatttttcaaagatgtgaattatggcaagtaataattgctgcctactattgaatatctggatgttgtagaactgccattgtatcatatttaacttatttttgagagtgttagatttcctctgatagaagatattttttacttttccaagattaatagtagaaatattgaacatcaaatcattttacagataatactgtcctaacattgcgtaagtatacaattattcatagactcagaaatcataattgtcttcacagaaagaaaccagttcagaatactttaagaactatttggaatgttagatttaaaatattctgtagccaaggtaaagcaagttagctaaaattccttttgtttctattgtttttagaactagcttcaaagagaaagaatttgataaatacttagtgtccaataggctctttcatacagttcaaagatgtagactgacactggcatctacagttcctagctgtacttactctggtattttttgccagctgccttcgtggtttctgcttcatacctgtttgtattcataaataactcaatctaagatttttagctttttaaaaagaattgcatacaatcatcatcagattacaggtttgaaagaaatcttagtttttttctttttcttttttttgagatggagttttgctgtcgttgcccaggctggagtgcgatggcgcaatatcggctcaccgcaacctccgccttctgggttcaagcgattctcctgcctcagcctcctgagtagctgggattacaggcatgcgtcaccacacctggctaattttgtatttgtagtagagatgaggtttctccatgttggtcaggctggtctcgaactcccgacctcaggtggtcttcccacctcggccgtctaaagtgctgggattacaggcgtgagccactgcgcctagcccagaaatcttagtctttttaactcagttttgagattctgccatatacctggcactgtagttaagagatggcatataaatgggaaaaataggtatttcaaaagcaatcaaaagcaattacaagactatatagtatgtcctaccacgggggtatgcatgggagcagaaggaagaagagacgaattttgcttggctagggttgtattggggttgaaattgatatcaactatagactagaaacttaaagggattttcatgccaacaagagtacaacaggccattcaagtccatctcttccaaacattgattaaacatcttttataggcagacaatcagttagttgctaagaagactaagctgaaaaaggcttttttttttttggccctgttggagctttcagcctattggctgattaaaaaaaaaaaaaaatgctgaggagtatgaagtcacaaaccaattgagttcaggaaccagtaagtagtttgacatgaccgtaatggaggttttgggatatgggcaattggcaaaaaattgaaaaggatgcgggaaaggtggactggggatacaatgtggatggatgattccttgctcaattgagatgaatgtgttcaaaaaaaccaggaagtttttttttatgttttgcatattagaaagttacatttggtggctatatgcagaatcgtgtatggggagagtacaggtgtggaggtcactcatgaggctaatgtctattcaaatgggagaagaggaaggtctgaaaggcaatcactattggaatacatgcaagtacatctagcattgttctgtctttctgaagatgtggaaatgaagctctctcagaattaaatgacaacatgccatggctgtttgttagagggaatggaagtagagattgaaggtcttgatttccagctgatcatcctttttatggtaccataccactcacccagcctgttgaactggaaaagattatgaacatcaggcattaacctaccaaagtaaagcaaaacaaaaacgctgaacttctccatatttttaaaaatatgtgacacatatatgtttattggaaattaaaatacagtaaaggctctttaactgtcattcaataaatattttttgaatgaacgacgatcacttgtcaataactggtattaaaaaagacaaatattaatggtgatctttattcaataatttcataaaatgggaacaaagtggtaatttgccagtaggatgaggagggcatagcagaggttgtctaaccttttggcaagggcaaagtcaaactggtgaataagcaacacaagctgtgatgagagtcatgtgccatatgtaaatggtgactctttcttcctccaatgctgtttatcaccacaggcttcccagcggcccaagaacagtctgccgcagtcactggcattaataaatgccatctctacctgaatgcccttcttttcaaatttttaccaaaaggaagatagtagactttcagttttccttctggctgtgagaggcatagggagaataacggtaacagatgcaggaataaaaaggcttgatacacatggatattatgtcatgagggattcaggagtttatattaatatacaaatattagttgttttttttttgtttgttttttgttttttgttttttttttgagacgtagtcttggtctgtcgcctaggctagagtgcagtggtgctgtctcaactcaatgcaacctccgcctcccgggttcaagcaactctcctgcctcagcctccccagtagctgggattacaggtacctgccactgtgcccggctaatttttgtgtttttaatagagatggggtttctccatctcggtcaggctggtctcgaactcctgacctcgtgatccacctgcctcagcctcccaaagtgttgggcttacaggcatgagccattgcacctggccccaatattacgatttatcctgccctacctcaccactcttttcatgattagagatggaaaaatttgatattatttaaaaatcagtaagattctatctaatcaaaccattggcagtataattcacaacttttttagagattttctaaagtaatacagatactgtagtattgtagttttgtagtatagctacaagaaaatcatactgtgctctgaaatgctatcttagtaacatattgtgttaatggattataatggtaatcaaaacctccatagagctacaggtttgaactctaacattctgtcgaagttaaagattaatcagtttaacaccatattatttttattatttttgagacgtagtctcactctgtcgcccaggctggggtgcagtggagcaatctcggctcactgcaagctccgcctcccaggttcatgccattctcctgccttagcctcccgagtagctgggactacaggcgcccgccactacacccggctaatttttgtctttttattagagagagatggggtttcaccgtgttagccaggatggtcttgatctcctgacctcgtgatccgccctcctcggcctcccaaagtgctgggattacaggcgtgagccaccgcgcccggcccattcctagtattttcaaatagaaatctgatgcctttattactgtaattagaggaatgcttatgtttcaggttgggttttggtaaagcccatgtggagaggagaatttgcatgaaagtagtttaattaaggaaatgttctcagggatggcaagtaggtgagcaagagaagtagaataggaatggggaagaaatcatgcaaggagcaatcgcaggcaaagtgccagcctcagtctggttctgcaggaaaacctgggcctaaactatgcttcagcttgttgcaacttgatacagaaggagctgggcttttgtattccagtagtcaccagtcattgccttaagactaccctaaggtgacataaacaccaaggcacttccggatctctgtttttgttggcaaagcagctttactagcctgaagacagtcatctaaagagatgtagatacagaagttttgagaagcaaagaccacaaaagccaaggaggtgggcacgcagaagtgttaatggaatcttagtggatctggataaaacacgattttttggctataacctctaaagggctaactttcagaagattacgtggacccaattaagcacttacctgaataattttgaaacatctctaattgtactatagctagagttaaaagaaaaaatattttctaatataaacaaaaagttcagaattatagcattattaaagaagcttttttcaaatgttagcattcctgcttcttgactttacatttttccggaacaaaatagttttccaaagagtatacttaatgacttgtgcagatgaattctaaatgataaccacagggctcttggacaagggatcatttaaattttgagttcttgtcagtcagacatatcaatccatatacatttccccaaccagggtgtcagaagtgtagtcaagtgagttttgtaatgatacttctttgtttacatctagctgcagaaacctcttaagactgattctgcatcagaataattgctagagggaaaagggaagctgtgattatgaaataacactgttatccactggcacccctttgtgtctatcttagttgaagctttgaggcacttctgtgtctattatttgattttaattggcaatggtattgattataaatcatttgacagaatataatttttatcttaaagtttaaatgtacctagaggctacaaagattcctgcgttcaatgaaaacattaaagtaatagtgtaagtagtttaaatgtgccccatttggcacagattagtgtcacctatggtacaactcagtcaaaaagtgaatgtagctgaaaactgaaactgttcaacagctccaaatttaagaaacacggaacattcactatgtgcaatagacaatgctagttttagtaggggattaaaaaaaaatatctttcagccaggggctcataaagtagtgaggaaacctacaacaacttcaagtcagataatgacaatatgtcattaagggacatgaacaaatgaccgagagaccgcaagatcaggagggactttttttggagttggttataaaggaatggcaaggcacatgggaatcaagaattcattcaaacagagccttgaagaaaggtgttggtggagtggaaggctagaacacaaaaatacaatctacagaataagaaagcactagggggcaactgtggttggagtacttacaagaacggtttaggaaaataactagttgtactacatagactaaattggataactgtcaagatttgaggattataggtgaagaaaccattttagagtttattataactgacattttgtatctagagacaacagggatatcagtattgatgtaattaaaggatgtggcaagaatgaggtgaaaataacttatgtcttagggctgaaaaattgagaggatggtggtatcattggatatggttagaaatagaaataagcaaaactatgatggggaagtgatttgtatttgggatatattgtctttgatgtattgatgggatatccaataatctccggaaaatatgtctggatctgaggagggaaatcagtgtgtgtttgataggtgtagcagtgagaaagtatcataggcaagataccacaactaaagaaaatggtttgggggtaatcaatatggagtttaagccatgggggcagatgatacggcaaaaggatattatacacagttaaaaaggaacccaaaaccaagtcttggagaattcacatttaaatacgtgcagatatagagaagccagcaaagaagtgttaggagaagtcacaggaaactgtaaagtgtctggtcacagaagcagcaagaaaaacagtttttaaggaggtgactacattgaccaaaggcagtgattgaattgaaatttacttggggtctgagaaaagaccattcggttttctggttgctttgactaattttaaagtaacaatttcagtggagtagtagaccataacctataaatgcattgatgtatttatttattcattcactcactaattcacttatccaatagtcattcatttattcttcggtgcttacaaccgggcctggcactggattaaagtgaaattagaagtagataaactggtagagatagccaaaacatatctccctacagaagggaaaagagcagaaaattatcatggaaacactttgcatagagtttctcacagcaggttgaaagtatcctaaggttatagcagtgtaggctggaggaaaaggagaaaatacagactaggcaggacaggcactggggaaattcaggtgtaactaagaagagactgagtgctgggagacagggtgtaatctgttaaatagaaacataggcaatagtaaatcagggaaccagaaagagttcaagagtcgatgaagagggacatgtatcaaggtctcgatcgagagggctgtgattcaaggcagagcctccattccagagggagcttaggatactcttctggttttctattactatgtaacaaaacaccccaagtacagtggcttaaaataacatctcttttatctttttatctgattttgtgaatcaggaattcagccgtgttcagcttattgatttttctactctgtgtggtgtcagttgacatcacttggcagaattcagctagtggatgtgctggtctggagggttcaagacagattcacttaatgcttaatgccattgtgagaatggctgaaaggctcagttcagcagggactgtcaaccagaggacttgtagatgtcttctacagcatggtggtttcagggtagtcagtttttatgcatggcatcttagggctcccagagtgagtattctaagaaacccataaagaggctaaaagttactaataatgatctaatcttggaagacctataacatcatattcgttgcattctacttggcagacaagttgctaagacaaatccgagctttaaggggagaattagatgctgcctcttgatgaaagaagtgtcaaataattttgtggccatttctagtccatcataactgctgtaaatttcctcctcctaccatggtattgagtgatgcatatctcacaggaggagagtgtgtcagtgactctagctgagaagggcagaagaaagaagatccttgcacaaacaagccaggcgagagagaaaactggcagtttttaggaaagaaaagagatgcatcttggcaggaaacaattgatggtagccagagttcaaggctcatgctgaccgttcattcttctacattttctaagctcaatctttgtatcaatagagaatatcagaaaacttccttggggaatcttactttggctctctgtaaaaatgaacttgtcgcaatgttctaccctcaacaatgggtgaacacagatttaagaaaaagacatgaaaagcttatctgttcttttgtgaaagtgccaaacactttctgttaaggttttcattgttgttaaagtgaaaatttggtatgacagctgctgtgagggatagacttaaggccttgcaactcaaattatggtctgcaatctaggagcaccagttgaggttttgttagaaatgtacattttcaggcgctatcctagacctcacacgagtctgcacttgactaacatcttcagaggtttcatgtgcaaacaaatgttgagaaactctgatctaagggatgtttcattattcagatcattgcaaaggacttgttaggttcctgttcttggtcttgtccctgtggacttcagattgaaaatcttacccttagcttaggctaagataaaattcctttccttttatttgatggcaattatacataacatgtcattacttgatttttattcgactttggagaagcaaagggttttggctaatttttagtaactattcttagcttttacaatgttatcattttatgtttgcattttttcctagccttatttagattctagacacagaataggggactgtgagtgctgagagtatccttagagaataaccactgtaacctacttcattttcatataagaaatgaatgctcagaaatgtgccttgatgtactcatggctacttaatcagtggtaaagctgagcctagaattatttcctcaaaattgtagtcctctgtacacttggatcagaattaacaggcaatgcatgtcataacgggctcatccaggtggttctaatatatactaaagtctgagaaacaggcctgagtgtagcttcaatgtctgctctctcactctaatgcctactgcctgccatatctagatgcctgtgtgtatgtgaacgaggagggaagagaattaaatcctagagatgttggtagccaattatctcaaaagcacatatttaggggtcagcttttaaaaggaggaggggggcttattcccctgacatttgagcaaagcaggaaagggtcggtgatgaaatgccatgtgtcctgaggacctacaggcctgggttatatgaccacttcaggaattgcatagcaatcaaaaagggaactaaaagaatcggaggctgggtaaaatcaggactaacaattgataaagcaattatgatcaacagtgagtgagagaaggagatttacctgatggtgaggtggtagccaccactaagattagtttaaataagattagccaccactaagagttttaaaatgaatgcatgaggcactggagtcttccattgcttctcttgccctccttgatgtcttctgacaggagccatagagatctttataaaacacaaactagatcatatctctcctacccaaagcctgtaaaagcatctctattacatttagtttaacatctctactgtggcttaccccttatccttctttgcccactaacttcatttagcatccacttcccctacttccctttgtgcatcttgtgcctgctatctgtaattcttccctttttataaaatctcctttttaagatcataccttgaattgtatctcttcagaaagggcttcctatagcttagccttaaaattctttttcagttgactttatttctaccttagcatgtaaaatgttgtcatctcttatttgttgttcatcttcttgagacagtaagctccagaaatgcagaaactaaatcattattcaatctaacctcatgtgatatctgtcacattgtagataatacttgaattttaaaaaggggacagaagtttcaagaacagtatactgtggtttaagtgagcaattcactgtgtgtgatccatggggtaggatggttcgaggtaggtgagaaagcatgaactggccatgaacatggacgcaaattgatcaaagtcattgcagcttagcaggtcaaaaagctgtgaggtcagagcatcagttaaaatgttcaatggtagttggtcatgatggcattagcaacctttaaatttaaagggacttaagtcacatccagaaatcggggatgacaagcctatagtcatcctctcttgaagtcttctgctgatacaagtaatcattcagtctgttggtctctatccccatgtcaccaccaacgatgactgggatccagtcaagcccttggatatcatgtcctctctcgtgtccttttcataccaatttaatcatgcctggagtgcccagaagcatactttcagtctcgcctgctttgacacctgactcattcatgccttaacctactgtgctagtgttatgatggggagggagggggtgactgagtggatttgacctcccaaaccatattctagcaagcaaggtacatcttaactctggaattcttctaaacctatatagggtttctgaaacttagtctcagagtgggagtggaatgatacagtactttgtcagaagctcataacaacgactgtgtcttaccataatccattacaatactgttcttgttccagttgaacagctggaagttgaaaaacatttcctttggaatgagtcaaactgtatcttacacaatcttcccagctcttatttacgagatagataatgtcattggtgctcaatatactaaggatttttcaatgcagggctctaatcttatcaatagattccagggaattactgagaaacacattatttgatccttgatgtctctttccttgtatttttatagtagcacgcttgaggaagtacacatatatagcttccaagaatgagggaaggcatcagttaatatgttaaaatagaaacctcccacttgatcttaagtatggggagggcgggggaaggagacaagccttaagcctgtttaccattgcaggtaaacaaacatgaagatcaaattctaagtaaggagagtttgttatggaatagctgagactgagggcataaagacaaccattcaaattattctagggtttcagaagacactgaagaaagaatagggagatgaactgttggtgaagcagagaggaaaaatagaccaagattaagagaaaaaaaacacgggaaaagattgcaggttggaggagggtgggtctatccaaggctgaggtcgaagcttacggcaaggatgcaggggaagaatgttttgttaatggtaaatagattgcaaaaattctgtagtttgcctgttcattctgatgatgggttttgtggttttttttttttttttttttttttttttttgctgtacagaagccttttagttctatctcagttgttaatttttagttttgttgcaattgactgatgtttttgtcaggaaatcaaaatctttgcctgtgcatatatcctgaatggtattgcttagattttcttacagggtttttatagttagtgggttttgtgtttaagtctttaatccatcttgagttaatttttgtataaggtgtaaggaaggtgtccagtttcagttttctgaatatggctagccagtcttcccagcaccatttattaaatagggaatcctttccccattgcttgtttttgtcaggtttgtcaaacatcagttggttgggtattagatgtgtgatcttatttccaagatgttggttctgttccattggtctatgtgtctgtttttctaccagtaccatgatgttttgggtagtatagtctgaagtcaggtagcattaggcttctagctttgttatttttgcttaggattgtcttggctatatgggctcctttttggttctgtatgaattttaaaacagttttctttttttctaattctgtgaataatgtcaatggtagataaatgggaatagcattgaatctataaattatacagtatggccattttcacagtattgattctatccatgagcatggaatgttcttccatttgtttgtgtcctcttagttccttgagcagtggtttgtagctctccttgaagaggtggtgcacttagcctgttagctgtattcctacttactttattctctttgtagccattgtaaatgggagttcatacatgatttggctctctgtctattgttgtaggaatgcttgtgatttttacacattgatttttgtatcctgagactttgctgaatttgcttgccagcttaaggagattttggggtgagacgatggagttttctagatacacagaagagacagtttgacttcctctcttcctatttatccttgatttctttctcttgcctgattgccctggccagaaattccaatacagtgttgaataggaatggtaagagagggcatccttgtcttgtgctggttttcaagggtttgtcataccaaaacctacagccagtttttgcccatctagtatgatattggctgtaggtttgtcataaatagctcttatttagagacatgttccatcaatacctaatctactgaaggtttttaacatgaaaggatgttgaattttatcaagacttttctgcgtctattcattcctttgcattcttttttctctaatcttgtctgctggtgttatttcagcaagataatcttcaagctctgaaattcattcttctgcttggtctatttggttattgatacttgcggtagcattgtgaagttcttgtgttttttcagctcccttgggtcatttatgttactctctagactgataattcttgttaacagctcctgtaatgttttatcatggctcttaacttctttgcattgggttagaccatgctcctttagctcagtaaagttcgttattactcatcttctgaagcctacttctgtcaattcagccgtctcagcctctgtccacttctgtgcccttgctggagaggagttgcaatcacttgcaggagaagaggcactctggctttttgagttttcagtgtttttgttttttgattctcatcttcatgagtttgtctagtttcaatcttggaggctgctgacctttggatggggttttaattgggattttttttgttgatgctgttgttgttgctttctgtttgcttttttaacaggtccctcttctatagggctgctgcagtttgttgggggttcgctccagaccccattcacctgggtcccttctgcacttggaaatgtcacctaaggaggctgcagaacagcaaagatggctgcctgctccttcctctagtatctctgtccctgagggtcactgaccagatgccagcaggaaccttcctgtataaggtgtctagcgactgctgttgggggtgggtctcacccagtcagggtgcacgggatccaggacccacttaaggaagcactctggctgccccttggtcgagggggtttgctgtcctgggggaatcccacttgtctgggcttcccggattctttagagccagcagggtaaagactaagtccgctgatctgcggagaccatggccacccctccccctaggggctcaggtccaggggaatcggagttctttccctaaacccctggctggagttactggaattcctgcaagcaggccctgcccagtgaggagggatgggtcagagtccggcctaatgaggcaatctggccattatttgccatagctggtgtgctgtactgcagggaattcctcctgggttcaaactgtccagtctccctcaaacctgaaggggaaaaatggtggactggagctgcagtgatggctgctgccctccctacaggagctcagtcctctcagtaagccggtagccaccgtgatggctgctgcccctccccacagcagctcagttctcttaggtggcagttctcttagatgccgcccctccccgggagagctcagtcatttgctgtaacaggcagctgcagtgatgatggccgcccccgcccccggaaactgagcagtcttaaggagtcgtctccatccgagtggcctgcgagaatctgcacagctgtgttttgagacccaaggccctgttggcatgggctcgcaagtgggatctcctgatctgcgggttgcacagatctgtggaaaaagaaagatttcccaggcagggtaggacaatcactcactacctcccttggctgggagtgggagcttcccttgtcgcgtttggctcccaggtgggccatggcaccaccctgcttttccttgcgctctcatgccaactgcctagtcagtcccagtgagagaacctggacacctctgttgctggtgcaggattcactcacggttttggttcttctcagtgggagcctctgactgcagctgttcctagttggtcatcttggcctctctccatatttttccatttttgatgtaactttaagtttttgcttaaattcccatattggatattacagtctaaaatcaagagaaggttaatgtggaccgagccattatttaaatttaaggttcaaagaggtaggtcattcagccaggtgagtgagcaccaatcttttaaaaagttggttaactatttgatagtttccacttttcaagctgataatgatattttaaaccaaggtcatttcaatttccttttggttcaatatttttggaaagttgctacctctttgaaataaaaatattttgtacaggattgtttacaattagcaaatgtttgctgataaagatgaatcactgaattaggtaccttttgtagttatgtaataaagctcttggtaaaaacttctatttaagcagttataactaatttttcctattgaaatgtcaggtacctattaagattttctcatagggcaattttaaattttttctttgagctttgtaagaaaaaaattgtcaactctactttcctttggctcttattcaactttattttaaaatgcatttttctagaaacactaactaaaggtgacagttttagttcacagggaactatttttgatttactatttttgttttggaaatgtctgaataaaccactggaaattatagcttataatgaagaaaacaagataaacacactttttatctaaagtgacagtaaaaatctagcaaatgggagaaaaataaagtcaacttttttttttttttaacttctccaattgaacgtcaaatgaacatattgggcaaggaatacaaccttagttgcatttacaatacagtggctacaacagaagagttaaacactaagtcttacgaaaggtagctttagaaatatttgaaagttggccgggtacggtggttcaggcctataatcccagcactttgggaggccgaggtgggcggatcacgaggtcaggagtttgagactggcctggccaatgtggtgaaaccctgtttctactaaaaaaatacaaaaatcagctgggcgtggtggcatgcgcctgtaatcccagctacttggaaggctgaggcaggagaatcgcttgacactgggagacggaggttgcagtgagctgagaccacaccactgcgctgcaggctgggcgaaagagtgaaactctgtccccccccccccacccccccacccccccccaaaaaaaagtgtgtgtatgtatatattaaggttgacactgtatttaaaaaatttctatgaaactgacaaaactattgcttcgttaattcttttttgcaagattgcattggaggaactgcatggaatataatgactgtgttcttttctaatagcacatgagtcagatctctagaaactgacttttgcccatattcaatttcagcagtaaaataatttctagcttgatatttctcataaaaactcctagggctcttttaaaaatattttataaatatctttataatgtggcttaatttttcagacatcttctgtgtagaaacaaatattcatatgtatgtacacatattagctattgctgtgtaataagccaccttgaaactcagtaggttaaaacaaccaacatactatttcaaatacatatgttagccaggaagttcttcaccttactgctaggattactcgtgtgtctctagttagctgggggttggctaaggggctttgctgatctcagctcagctctgcgaaatgtctggctgtctgctagtctgggaaaacttcatctgggacaactagggcaacttgactcggttccacttgtctcatcctcctgctgtctagctctgatgtgctcttacggtaaatgcagaggcatgaacaagagagcaaaagtgttcaagcccttttgaggtctacatttgggagaggaaatgccagcacttcaattgcactctgttggtcaaaatgagtcaaatgccaacccagatttaagaagcagggaaatagataccaacttttcatgagaagaacagcaatgctacattgcaaagggtatggattcaggaaaggatgaaatactaggcccaattttgtagttaacttaccatttacagcagttgctcctggacagtatggcttccttgccaaatatttttgcatgcaaataattggtaaacagtgccaatattggtttttcctaaacaatactatgttaaagtgtcagtcaaaatatgaattaaaaaatgcaaaacatggtaagagcttctcaaaattagttatgtttgaaagggtgaaaagaaaagacaagcagacatttgcctaagcagctttgggtggttaatcaagtcggtacactcggatggggtgtcttgtacctctctagtctcatgttccatccgtccacttacgttccaagaagtggcttatagttccttgaacagtgcgtctatttcatctgatccttagcatgtgaagtttcctctgcttgactttatcttccctttacacttctacctgttgataacctgttcaaccttgtatattctattcagggattttcactctgttgttctctccagtgaagatatcttttatttgtgccagcaccatacttacgacaaaaaaatcactattaataggattataacaccatgctataattatattcgcttaaatgtatatttccttcctaggctattacaaaagctgtgaaaacagtggcagtatgtttttatcttttatcttcccatttttcttaggacagtatgatgcataatactggttacatttagttgaatgactatccccctcgtctgacacataaggaaaataagccaagtgctatgtaatttatcagtgttcacacaactggcaaaatttaaattatagaactgtaataaataaaggcctatttgcttccagatactatattatttaacttacaactacaccgaatctcacatggaagactttcaagtaaggaactggcacttttcagtggatcttaagaaatggctacactaaatgccctagttaaactttttcttctgtttactactacctcatttaatccttatcaacttcaaggattatatttcttatattttgatttatatagccttaagtttttgttgaatgatatttcttctttagttaatataaaaagccacatttttcaaatacattagagtgaattatacattcgaacaatttgcagtgtgctctaaaatagtatttagtaattgagtctgctgagcacactggagtcctgaggagttaatgaaacccccgatgtcaaatgatataacaataggaatttgggactttgaagaattttcctaatgtatatatgtagaattatcactgttactatctttccattacaaatgggacctacaattaggagcaattttattggcaggctatataactgtatctgaccttttggaaatgatagaagaaagaaaagatatattaaactatctttgtagaaaagatgacgtaaaggctcaagtaaaactcacctaacccttgcccctgaatgtgatgatagtcaagcccagcttaaacagcagttgcaaagtaaagaatggtgtagagatctgtagatacactgcctaagtccaaattagtatctagcacttacttgctgtgtgaccttattcaagttacttatattgtgtctgtttcatcagttgtaaaatgggggtgactgtgaacattaaaacaacccacaaaaagtacacagaagtagcgctgacataaaccagtcgatgtgtgtaactcgcatctttctgatacatgaggtagagtcatataaaaattgtaatatttgacaatatttgacttcagaattggaaattgcataaagttggaccactaaaaggaaataaagcatagcagtgacagacgttctcctttaaatattttatcctctgtgacttttgacagaagatcttctttaaatattgtatcctatgtgacatttatcttttctgtgtttccaatttctttgatttggaacttcctgtagacagacccttacaggcatggaagaagaaagaatgaataaaccaaggatgacttcccagtaggtggaggatgggaataattaggaagaagctgtgtcttgtcacctatattgtccatacacaactgcaccgtagggtaattgagaaattataagaatggtaataaatacgttttacattcattaattaaagtcatctttggatgccctttgtccataatgtttcctctactagatctgaagcctaaatatcacttttcttctctgcaatttccctggaactgagtactcatagatgtttgtctagtgagccattccattatgtcatggtatatgtgtgtatttgtgtgtgtgtgtgtgtgtgtgtgtgtgtgtgtgtgtataaacacaatcttttttttttttttttgagacggagtctcactctgccacccaggctggagtgcagtggtgcaatcttggctcactgcaacctctgcctcccagattctctcccaccttagcctcccaagtagctgggacttcaggcgcgtgccaccatgcccagctaacttttgtatttttagtaaaggtggagtttcgccacgttggccaggctggtctcaaactcctggcttcaagtgatctgcccttctcggcctcccaaagtactggggttacaggcatgagccactgcgcctagcctatagatttcttttttgaagaatcagtgttatttgcatgctttgaaacaaagtgcttcatcttgccaaccttgtaccataccgtttctgtcagaaaagcaaccattgggatagattgtaattagccttcatttccatcactggctatctcaaatgcaaatcatgtatctatgtgaatcaaaagaaaaactggatttaggcctggtgcagtggctcatgcctgtaaatctcagcactttgggaggctgaggcaggtggatcacgaggtcaggaggtcgagaccagcctggctaacaaggtgaaaccccgtctctactaaaaatataaaaaaattagccaagcgtagtggctcgcgcctgtaatcccagctactagggacgcggaggcaggagaatcgcttgaacctgggaggcggaggttgcagtgagccaagatcacgccactacactccagccaaggtgacagagtctcaacaacaacaaaaaactgggtttaactttcagaatgttcaattttataggggatatttaaaggtggtgtaattagtataatcatggattgtaatcattccacaaattttaaaataactttgtgaattacattaatacataaaaatataagataaagcatttaccataattttattaatatttcctttagaatacctggtaaaatgaatgagtactgacctaacttaaagataaaacaattgagacctagctttagaagttagttttattacaaaacatgttaaggatagacctgatcagacaatgaatcatgctgactttttgttaagcatacttctgggttcataacatcccacttacatataacaacttgatttccattaacgatggtgtggtttcctatttaaagttcgaatgcacatctgtttgaatcatttctagtgtacttaatagagtaacatacatattgggttctagttaagatgctttataaaatgccaaataacattttatatctggagagattataaaaacttgtattttgtagctttgctcttgaacacttgctagctgcaaggaataacttggctttttcttgatgatcttcatagccagattttcgtgctttttttggtagagagaagtctctacaagtatttgacgctaaggaataatgaataaatacctactgattttatctgctaaggtccacaaaacattccagtattttgatatcactattaaagaagacgacggtgttccagtgatacatatgattccttacaatgacatcaccagagatagaaatatgaggcatgggaagtaacacgtaggccttcatttattttctgatatggacatccctggcattgatctccttggctcaaaggaaatttgcttccatgtctagggtggtgaatgtctttggcttatttctttggccctactctccacttttgtcttccttgggaggctgatgtctgtggactacatcaacaggctcctttgccctctggctactagttggatttggccaatgagagccttggtaagagagggagagaggaaagaaattccatcacccaatatcaaagctcctgtcagataatcttctcttctcagttctctctctatgtagtaactagaaaccactctccttcttttcattcttaggagtctaagagtagtagtgacacttctctattactagttccagtggtttcattataccttccctcatttttataaacagtcccttattaaactcttctcagattaccaaagtcctgctatggccatataaatttcaaaggagagtgtcattctccacctccaggtgataacatttaacaggagggaatgtaatttatttaatgtttttattgagcattttctatgctaggtaccataccagacatcttacatttattaacccttttaattctcatattttgaagttggtcccttctgttactttgaggccaacattacaaggaaagttatagacgatatggattatttggcttagaaagtttggaataaacgtgtgatagctaacacttacagaatatatcttacaaagtgccatactaagttcacttaaatctttgcaatatcaccacaacataggtaatgatacatgctctttctatagatgaaaagagtaaggcacggagaagttacttgcccaagatcacactgcagagctgggagttgaacccaaggcattctgggtgtacagtcaacattcttattcatggcatcataccattcccccgtgttttccaaagcatattttatcagtgtgacttttttctaaattccctctgcataaatctaatgtatttcagtcactagtattctaactcaaaatacaaaaccagcatttttctatctttaggtgactcctttcaagagaaaactaacctatgatgccacaagtcgtcatagtggccattcttgaggggagcttccacatagggggtgtgaggaagctgctagggtgttgatcatattctgtttcttaaatctcgatgctggtaatataaatatgttcggtttgtgacaattcattgagctgtacacttaagacgtgtactttcctctatgtatattattccgcaacagaatactgctttattatacaataccttttccaactcatatttaagaaaacaaaaaaaaaatcaactcggaaagcttcctatttacatgaaaatgggttgccttatttttctgggagctggtcagcagcgttcttcagtaagttttgaatccccagttttgcaattctttgtggtatttgcgatatttttggtgtttccaatgtctagggatttgtaattgcagaagtatcttgactttcttagcgacagttatgtccatggcttgtcctttttgtaatcagaaggtcatgctaaattatccctgtgttctttactttctactgaaacgtattgatccctttggattttcaggttaaaagaccaatacaactctgaagaatcagaaaccacttaaacaccttcacaaatgcatttcctttctcaaatttttttactttgatttgttccactttgatttggttcactttatttatgccacttgtcaacctacctatctgtgtttctttttgaacactgtttgtgcttccgtatttctttatttcatactaaaaaggatttggaaggaatactgtctcgtttttaggtcctttcgtgttgtggtttgggttaacaaagacaatatatatgcagatacattaaactgagtaatatcagatatccactcagttcacttgataagggaaatcttagtcataaaatgaactgaagacagagagctacagggtcgcctggcccaaggaggaattcatgttttgtgtgcttcacaaaatagttctcatacacttgaaaaggaagccattaaaggttgaattttaaagaaaaaatattgttcttaggatataaaatgccacctgcaacaaagacatggtgtatgttgaagatgaaaggggagaacaacaaaagaatacttaaaaatagtcaaaagaacaagaaaagggaggaaaaagcaagtttctaagtgcatcctctgtaccatctgcattcaccagttttagtaattgtatagggaataatgccttcccctattgacttgcactcccacagggatgccaaactaatagaaaacattttacatgtattctgcactttctaatataatatttttatattatcgaaaagactttaacttgtgtgtgtgtgtgtgtgtgtgtgtgtgtgtgtgtgtgtgtgtgtgtgtgagatcttgcttcgtcacaaaggccggagtgcagtggcacgatctcggctcactgcaacctccaccttcctagttctagcgattctcctgcctcagcctctcgagtagttgggatcacaggtgtgtgccaccacgcccagctaattcttgtatttttagtagagacatggtttgaccatgttggccaggctggtctcgaactcctgaccttaagtgagccacctgcctcagcgtcccaaagtgctaggattacaggtgtgagccactgcacctggccgagttaaacgtttttacacctagaatttggtcaaagaaagagatgcagacaaatagtgttaaaatgaaacataaaaatcaatctatatttattgagtgcatacgatttgccaaatctgtataacgttcctatgtgttgcagttgaacctcacgggagtgctctggagtaataatttgagccccattctaatagtgaataaattgtgcctcagaaaggctgtcacttgcccaagataacacagctagtgagtgagtgagagacctgagttcagaagttagctatttctgcttctgaaacttgggttacttttgctatagtatctataattctatagagtaagttgcaggcaggaaaattagaaccatccaagagaaatagtatgttagattttacctggggtattcatactacagggagaataaaactgagcaccgaaaggtctataaagttacaggctaaatgtagcacatttcactaaaaaaaaaaccacatcagaccgtgggaacgggggtgggggagatttttactcaaaagtacttaaaattacttttacataagtccaggtgtgatggctcatgcctgtaatcccagtactttgggaagctgagggaggcggatcacaaggtcaagagatggagacaagcctgaccaacatagtgaaaccccgtctctactaaaaatacaaaactgagctggacgtgatgacacatgcctgtagtcccagctacttgggaggctgaggcaggagaatcacttgaacctgggaggcggaggttgcagtgagccaagattgcgccactgcactccagcctggcaacagagcgagactctgtctcaaaaaataaatgataaataaatagttttacgttgaaacaagcatatattaaaagaagaaggcaaaatctctaggaatttttagcataaagtatatgctttcaaagaaatttaaaacctgcaggcactgtgtaatttatactgccagactccagggtaaattccttcaatttcatttcctggaaggatgctctggtagaatattctgagaagcactctattagagaatatggtgaatatgactaatagaaattggatttcaattgtgatactttaatatatcattgactctgtgagtttcgaaaataatacgatagcaggaactgtttctctatcacctcactgctttctctctctcggtgccccagctaggtgtacatggaatcccctacctgacctataatcctttactccctctccattttggttacctccagttttaaaagaagacttataaaagaccttggtctatgtatttaagtttggcccacaaagcaagattctgtctgcgtttttgacctttgcctagactttgtctccaaacccaaacgtagtccttgtgtcttggatgctatatgatcctgatggctttgggattcatgttttattctgtactccaagacttctctcacctttcccagtctctgctcctctttttgaataaacagcagtttatcacgcacatacttcttggtctgacagacttcaactttctaccctggattttttcttttcataaaaacaagtatctctgtcagttaacagttaactatattttcttcaacaatggacacattgcagtgcataagattattttttgatgagtttaaaagtcatgctttgctcagataagtgtgaaattttgctcctggccaaaggagggaaaaaaacacatcattttaatggcattgtataccttcattcaatttgaaaaacaaattattacactcaaaataccaaattattccaggttagatatgaagttcttggcagcactattagaaagtgtaaatttattttcttattactagagagctttccttaaagtttcattaaaatggcactgttttaagatttatgtgtatattatgtatagtaaagttgctttgttttagattaaatttatggatacatagtatatttagggggtaaatagatatattgatacaggcatgcgaagcataatcatatcagggtaagtgaagtatctgtcacctcaagaatgtatcctttctttgtgccacaaacattccacttcaaatttttttttttttttgagacgcagtcttgctctgtcacccagggtggagtgcagtgatgctatctgggctcattgcaagctccgcctcccgggttcacgccgttctcctgcctcagcctcccaagtagctgggactgcaggtgcccgccaccaagcccacctaattttttgtatttttagtagagacggggtttcactgtgttagccaggatggtctcgatctcctgacctcatgatccgcctgcctcggcctcccaaagtgttgggattacaggcgtgagccaccgtgcctggcccaaattcttaaatgtacagtaaattgttgactgtaatcaccctcttgtgttgccaaatagatcttactcattctaactagatttttgtacccactaaacattcccactcctcctgtccccaactacccatactacactctggtaaacatcattctactctctgtctccatgagttcaattgctttaatttttagttactgcatatgagtgagcccatgcaaagtttgtttttgtgcctggcttatttcacttaatacaatgtattccagttccatccacgttgttgcaaatgacagcgtctcatttttttttatgactgagtagtactccactacgtatatatgtaccacattttctttatccattcatttgttaatggatacttggattgcttccaaatcttggctattgtgaatagggttgcaataaacatgagggtgcagatatttctttgacaaactgatttcctttcttttgggtatatacccggcagtaggattgctggattatatggtagttctgttttcagtttttttgaagaacctcaaacagttcttcacagtggttctactactttacatccccaacaacgatgtaccaaggttcccttttccacacagccgcatcagcattgatgttgcctgtctgttggatataagccattttaactggggtgagatgatacctcattgtagttttgatttacatttctctgatcaatgatagtgacaaccttttcatattcctctttgacatttgtgtcatctcttgagaaatctctattcaaatttttgcccttctttcaatcagatgattatatatatttttttctatggagttgtttgagccccttatagattttggttattccttgtcaggtgggtagttggccagtattctctcctactctgtgtgttgtgtcttcactttgttgattgtattccttgctgtgtagaagctttttaacttgatgtctcatttgtgcatgtttgctttgattgcttgtgcttggtagggtattgctcaagaaatatttgcctagaccagtgtcttggagattttatcccaatgatttcttgtagtagtttcatagtttgaggccttagatttaagtctttgttccacttagattgatacttttgtatatggcgagagataagggtctaatttcattcttttgcatatccatatccagttttctcagcaccatttattgaaaagatggtcttttcttcagtgtatgttcttggcacctttgttaaaaatgagtttactttaggtctgtggagttgtgtctgggctctattctgttccattggtctatgtgtctgtttttatgccattagcatgcatttttggttagtatagctctgtagtataatttgaagtcaggtaatgggattcctagttttgtaaacaaggatcatttgattcttccttttcaatctggatgccctttgtttctttctttgatctagctaggacttgtagtaatatgttaaacaacagtagtgaaagtgggcatccttgttacagatcttagagaaaagtcttgtagtttttccccattcagtatgaaattagctgtgggtttctcatatgtggcttttactgtgttaaggtatgctgcttctatacccagttttgagagtttttatcatgaaggcatgttgaatttttatcaaatgctttttcagcatctattgaaatgatatggtttttgtccttcattctgttcatacgatctatcacattgattttttgcatatggtgacccatcttggcatccctaggacaaataccacttggttataacgaatgacctttttaatgttgtgttgaatttggtttgctagtattttgttgaggatttttgtatcagtatttgtcagagataatagcctgcagttttgttttctggatatctgtctggttttcgtgtcaggctaatattggcctcacagaatgagttcagaagtacttcctcctcctctttttcacaatagtttgagtattaggtgtttcaatgtttggtaacattcagcagtgaagccatcaggtctcgggcttttcttcactgggagactttttacatctttgatctcattacttgttgttggtctgttcgggttttgcatgtcttcatgacacaatctaattttgagtttggtttgctattctagttctttaagatgtattgtttctcttttttttttttttttgatacaagtgcttattgctgtaaactttgctagtactgatttatctgtagcccacaagttttagtatgctgtgtttacagttttgtttcaagaaattttataacttccttatgaatttcttcattgacccactgatcattcaagagaatatagattaattcccttgtgttttgtataattttcaaaattcctcattactgatttctcagttcattcaactgtggtcagataagatactttatatttcaattttttgaatttaaggcttgttttgtggcctaacatatggcccatccttgagaatcctccatgtggtgatgagaggaatgtacactctgcagctgttggttgaaatgttctgtaaatatttattaggtacatttagtctgtagtacagattaagttcaatgtttcctagttgactttttgcctgatgacgtccaaggctgaaagtggggtattgaggtttccagctctctttaggtctaataatgttgctttatatatctgggtgctccggtgttcggtacgtatatatttacaattggtatatcttattgctgaaatgattcctttattatatgttgatctttgtctcttcttacagtttgtcttgaaatatattttgtttgatgtaagaatagctactcctgttcttttttggttgctatcgacatggaatatctttttacatcccttaattttaagtctggctttgtaggtgaagcgtgtttcttgtaggcaacagattgagtcttggtgtttgttgttgttgttgttgtttgtttttttttttttttttctgtcactgtgttttgattggagagtttatttcatttatgttcagttttattattaagaacttattcctaccattttgttttctggttgttttgtggctttctcttccatcctgtcttcctttttagtgaaggcgatttttctctagtggcatgcttttatttcttgctttttaaattttgtgaatcttagtatatcttcttatttgaggctaccatgaggtttacaaacactataacccattatttcaaacagacaacactggttgcataaacaagaaagcaaagagaaaactaattaaaaactcaaacttcgtctcttttaatctttttgttgtttgtttatatctcattatactgtctatgtcttaaagttattagagttatttgttaactgaaagcttcctttttttactcttcttattcaagatatgagtagttcatacatcacaattacagtattacaatagtttgtgtttgtctgtacttactgagttttgtgccttcagatggtttttctggctagttaaggtcctcttctttccagttgataaattctctttagcatttcttgtagaacaggtctggtgttgatgaaatcccacagcttctgtcttggaaggtctttatctttcttgttggaaggagattttcactggatgcactatcctagcataaagggtcttttccttcagcactttaaatatggcatgacatgtcttagcctgtaagttttctgctgagaagcctgttactagttgttgttaagctttttggaatgtatcttttctcttgctgcttttaggatcctgtctttatccttgacttttgatgcttgccatctaggagccaaggcctgaagttgcatctttatgaatctatctggtgctctcttctattgtggcagagctggcacccaagccacaatacaaagtttgtcccattcttcctttcccatttcataagcagaggaatttttccccatggctaccactgcctcaggctcatggtgagtactgcctggctaccactgatgttcactcaaggcccaagagctttttagttaactaggagtaaacgctgcgaggcctgggtctctccgttctgtgcagtgggttctcctcaggccccaggtgagtccagaaatgccatccaggagccaaggcctgcaatcagagaacccaggagcttgcttgatggtctacctgactgtggttgagctagtacccaagctgcaagacaaagtccactctattgcctctcctttccaaaagcacaaggagtatatccccatggccaccacacttgggaatgcattgggccacacccaaagacagcatggctctgagtcttacccaagacttggtgaatactgcctggctactactgctgcttattcaggacccagggactctttagtcagcaggtgacgaattctaccaggactggattcttctcttcaaggtagcaagttcccttctggccctgggtgtatttaagaatgtcactcaggagccagggcctggaatggggggtctcaggactctgcctgatgccttatcctactgtggttgagcttgtgtccaagttgcaagacaatgtcatctttactgtccctatcctctcctcaagtggaagaagcagtctctctcaaagctgtcagctgcactgttaggggttagaggatggggtggtacaagcactggtgtcttactgggttgtgtgcccaccaagtcccctgacttcgagtccagcacgacaccaagacttgcccaggaattgcagtttttgtagcctagactccctttgaagtttatttaggaccccaaagtgcttgagctcacactggtgagactagctggaactcagcttctaactgctgagatgggtgatacctccctggatagggctggtctaaatgtgccctctatgtgcgcttgatgaattctgccctgtgttgcttcccactgtgacagggcagcactgggttccaatgcaacgtttcacaatcctgcgccctccctcctgcaagcacacagatcgtctacatgagacatggcctctgccaggggatgggggaggggtggtgttggcaattcgtaactgtctttcctaccatcttcagtgcctctttccttgatatgatattaaaatcaagtactgtgattgctcacttgatttttggtttttatgtaggtgcttgcttgtgtggctatctgttcagtttggtgtttctatagcagcggtagcgggaaagatgattgctggaaggttccatgtatttgaccgtcttgttctgcctccctcctagtaaagctattctttaaaaattctagcatgttagggttttgtgttatgttctttttcccatggaatttgaaaatggatctatttgagtagaatttcaaaagaataactcataatttttgtctaagtatatatgtggctggattcacaaagctgggcacacagggactggttggttgccgcaggtatcattgttccctgcttgaagtacccgggcatttacaggtcttgtcattgacatggctacctggttgtaggaatagtctaaatcctatgtttttaatcgtggaagtttaagggatgtcttttgcctggaaaccagggattttcttgacttgtgtgaaattcaaagtttatatgtgatccaaggagtgtatgtaaagagcacagtcacccaaaggctaatgttagacccatcacctgacgttttttggaaagtatttgttgatcccaaggcttgtgagagctcccactgttacatgttctttagtcctttctaatgcttctatgtaatagtaccttttaggaatattttctttgctggactctaagttctatagggtctgggcctatgtctgatgtactagcatatgattcagtacctagctcaggtttattcatgctcaatatgtctttgactgattaaattagggatttccagataggtgatgaaaaagctgggaattacctcatgaggggattgtagggttttaagcagaaaacgatttggtgaagtatgacaaaagaaagacaaatgttagaaagataatcaaatagtaggttataaaaggacaaggaagcaacataagattgaaagaacaagaacccagaattagacagatctgagccataattttggctttaccccattctagtttcatgacaaagagccacatactcatcttacatgagatacttagaggttaagtatgttactgctaatctcagaaatgccacaacggttatgaaatccactcatttaatagtgtgtctcatgagtatttacgttaaaaatgttaaatattatttattgactattatttttccttagtataattcctgagcaaagaactgagtaaaatagatgaaaagctctcacagggttgtttcaaacctaattaaacccgatattcctaaaatttgagttatccagtatgagaataggtcatagcatgcaaaatgtgtatgcacagcaagcatgttttgagtgataaggatgtcgaaccactctgactggtatattccaagaatggttaaactttatgtacccacccaggtagattgtggtcttttgcttctttgtgtatttacttttccctttacccgtaactgccttgatcatgcctgtattttttctctccttcatagaatctatattcatttcagtgaattaattagatcatttagggtataaatctcttactcttgctattcaaactaattcaaatagacttgacctatgataaaatttttaaattttttttgtcatttgaactttccttttttcatccgtcatcttcggcagattaattatgcacactaattatccttaaatatagctttagttttcaaaaggggataatcgtgaaaatgtatcattggaagtgtgctttgttaaattgagtgtattttttttaatttcagtttgggaagcagcatattgagaacctcttcagtgacctacaggatgggaggcgcctcctagacctcctcgaaggcctgacagggcaaaaactggtatgtgacttatttttaagaaagttaactttaaacttagtagaatttcagaccagaaactgacaacatagttttatgacatctagtagaatgactaggtactgattgaaacagcaatacctattccttagtaaagcaacctcgtatgattttcatttggcatactctaccgcctgcagaaaaagtaaaaatttcagtaatacaatttatattaatagatattattcagttttactacttggtatctatcttatcaaatatcttaatgaaggcttttatacataatgacttgagaaattatctttgtacttttgtgtatttttgaagttattttacaaggaacctgtatgagtttatacatgtgggatagcaaaataaggtacaggcattatagtgtaatacgtgatagcatatgtgatgaaaatatcacttcctcttgaactattatcttgtctaacttcagagcattcctgtgaagatacatgattgatatacatgattacagatcagtgaagtcatgttgatcaaggtcttacactggggggggaaagaactcaaattgaaatcccctgactgaaataatcgtcttagattgctattctaaaaagtagagtttaagcccccagtctatagtcataaataactgttctacctatcaaattctgctaaatcatagccttcgtctcttatctttgcccttcattacaactccccagcacatgcacatacacacacagacacacacagattttgtcatattatacaaactgaagctgtcgttcaaagtcagttagcaaaaatcctatctaccccagcctgcctcctgtaacacttaacgctaagccactcttttctcggtatatattgtcagatatctctgggtttttgcctgtattattttacttgcctgtatttctttttgtacttctgtctaccccaactgtctgccagaaaccttgatttcacctcagtaaagcttttcccaaattacctttgctaatttttccctcccaaattccacagaaggcccatttttgtcttgtttttagtgtatgtatgactgacatccctcctcaattaaattctgaagtcctatacagaagagacatacctatgctttcattttttatcttcagctatgtgagattaatactaaaacggatccatttttttcaagaagtctgaacttgtactaatagaagaacaacttgatgacatattgaaataataactttagtcaagggggaaaatcagatttaataccttatagctgaactgtttgctgggcgccaatttgaggtcatcatgtaaacttggtcttaatttcactagttagagatagatttgtgtgtaattcatctcctatgactgtgaacaatttacatatatatggatacgtagcatatgtacagaaatcagtgtgtctgtgtatctcgtttctcctgtattctgaagtcagtcctactttgttaccgaatacagaagtcccagtgtcttccaaatgttcgtgaaaaatctttcaaagattatggcttactcatcttgtcctggccctctgttaggaggctgttgtctcttcacttccaggtatctgcgtgatcacttctcctgtgttgcaatcctctggtcatttccctgactgagtcaatccatctatcacccaaagcaatttagtcagggttaacaaatttcatacataatgtttaagataatgaatttcagatcctttcgtaattcataagcatgatttgggtgtttatactcagatatgagataagcctttctctaaacttatgatgttggcacactacccatttgatataaagaaaaaaccactaatttcggcaaaattaaaaaatccacatgatttgcatttatgcatatacatacatagacgctaagacaaaatgaacctaattagtaatagcattaaagaaaaaaatatcaaacaaaatatccatgagattggccagtataaggtaagctagtggtagggaaaaatcaccaaacatttacacatggcagtgtagattacataatttcagatactgctactaacagaatccattcaccattgtttgtcctaatcacagatctgtcagccctggtctgaggattttgcctttctcataaagcagaatcacctctaacaaatgctcccgatcccagaactccaattcgctatgccttgtcttgaattctaatagtttctgtagagatatatcttctactcctaatgggaggcatgtatactatagaacagaaattttagtattctactcagaagcatctgcatttggattattggctcaggacatccccagggttaaaaggaaggtacttgccttacaatcataaaataagaaatactccccaaggagactctaataggggcagattttaagttcccacttcaggatcagaaactgcagctttttaaaagagtagactatgtttggttctaatacatatgcacatgtgtacatttaatgtttgaatatgatacaaaggaaaattttgctaaatcttgtgactatataattacataattgaaaggaaatatgtggctttggtctaactactaggcagagaactgatttgagtaattattttcaaaactttaaagtcctataattaccattaaacttgtatactgtcaatctatatatacacaagaagattggttatttgctgtttttctttcatgtattttttttttattttgatggaatcttactctgtcgcccaggctggagtcagcgacatgatcttggctcactgcaacctctgcctcctgggttcaagcaattttcctgcctcggcctcccaagtagctgagactacaggcatgttccatcatgcctggctaagttttgtatttttagtagacatggggtttcaccatgttggccaggctggtcttgagctcctgatctcaatgagccacctgcctcagcctccccaaatgtctggctgttgcttttttttttttttttttttttttaaatctaaagtcttatttttttcctctttttggtggaaagtgggagaaatatcagaatgtaaaccaacatcattctgacattcttggaggaaaatctaagaggtaaaaatggagattctggttcataaggttagccttaatgttttgtgaaatcaaaggaacaagatgtcaatactgtgttataaaggatatcaggcaagttaccttggagagtaagatggctttagcttaatttgggttgttcagcaggcagtgcaaatgataaggagttctagggtgaggaactacttgagaaagaccaggagctttgctggaaagtataggagttaaatgcaagacacagaaatatagatatttgtttggtgcatgcacaaggtagttagagaagaaggaaataaatttgcaagactggggctctacagacacagacaaaagtttgggtcctggctccaccaattattagttatatggtaatctatatattagatattttaacctgaggttcacttctgtacaatagggatgaaactaactgccttgcaaggcggggattaaaggtagtgcattcaaagtacttggcacatactacgaagtcaataatatttatgttggaccaactatgtgacaagcaccaatcttagtgctttatgcatatcgacacactgaattctgccagaaaccatatgtacaatggtttgagcaatatgaacaataagtagtgccctggacaaggtctggatcctgtgagacagcatgcttcatgtttgagtgagggctttgacctcaaatgcagagaagaaagtatgtcgaattctcttgtaaatcagagcagttgttattgagagcacatgttgtaacttgtgtatgcctcttgctaatattttcattaagtccatttttaacagatgagaaaactggtatacagggagattaaattttttatgtaggccagacagcacaaaaacagcagagctgacaattgaacccaggcagtcagctttgtagctcttgcccttaactgttacctataatcacccaaatgtttaggtgagaactttgcaagtggtttgcattggcagtgggcttacttcaggaacgtcattgttgatggtatgaaggaaggatgaaaaaaatggtgagtgagtggagaagggaaagaggttagatttctctgggcaatagctaataagggcttgtagtaaggtaaaagaaatgaaaatgagagtaaataaaacaggttatcataatggtagaatttctaaaactctacaacttaataaatgagttaatttgtatattacaatgaactatgcagatgttggtttaaaaattacaggataagatacaacttttgggattgagaataaaattagggaaccaaagtgattgaggtttagagcttcagtgacaaggacaattaaggtaatcttcacagaaaaggtttcctttaaccctatttggcattatataattttgctagagtcaaatctcctttagatttttctaaaaagtttgggaattgtttttctatcttactagaaaatgtttttatgcatgctgatgtttctgtcattggtggtcatgcagtaatccccaactgggctatagaatgaagaaacaatcataccaaaataggctttgtaaagaaaaagtgttgccattcttagagtggttggtttatgctaaaaacgtaccaggccaaggacaattagcgcaaagtatttagattcattatattaatgcctcacaggctctgttcgtttacaatattcaagcttaatagtgaaattataaatggtttcatttctagtagattgtcggtctctctgctggtcagtgaacactcttttgttttgttctcagccaaaagaaaaaggatccacaagagttcatgccctgaacaatgtcaacaaggcactgcgggttttgcagaacaataatgtaagtagtaccctggacaaggtctggatgctgtgacacagcatgcttcatgtttgagtgagggctttggccccaaatgcagagaaagtatttcaaattctcttgtaaatcagaccagttcttactgagagcacatgttgtaattcgtgtatgcctgattgtggctaatataattcaggaagcaaatgcatgctgccacagagggaagggaaaagacatagacctgacctgataggctgctccctgttttcagattttacttcatgaagctgtgtttggtggacaaagtcctgcagtcaactcggtttcttttcttactttgcttttctttttcttttttcttttcttttcttttcttttctttttttttttttttgagatggagtctcgctcttctgtcccaggctggagtgcagtggcgtgatctcggctcactgcaaactctgccttccaggtttaagctattctcctgtctcagcctcccgagtagctgggattacaggcacatgccactatggccagctaatttttgtatttttagtagagacagggtttcaccatgttggccaaggctagtctcgaactcctgacctcaggtgatccacctgcctcagcctcccgaagtgctgagattacaggcgtgagccaccgtgcccggtgaactctgtttcttacggcagtgttttgtgcaacaaacggatttttctataccaaatatttatgtactaaatgtgttcaaacctgataatgatgtttgtttaaatcaagccaacacttattaaacgctgtctccaagcatataaattatacagaaacatcactatttttacttggggtatgaatggcagatttgtttttttggtttagatttaactggattaaaatacgtgtgttgcattagaagaagtaaacagtcacagctaaaccaagtaggcaggtcagaggaattctaatctcctctgaaccacttggtgactcttcccctgtgtcatggcattggaggcagccttcctttcttattaacatcctaaaatctgtctaatcgaccaatacatttcaccaggcacttagtagctccctaattacattacctctctctttcaaagataaactcaagtacattgagtacgttgatcacttactcttaaaataaccataagcagggatagattaataataacatgtactcccccaaatgttgctcagcttatctggcagggagatgacattacataagatatggaaatggaaactgtgcagcaattaattggctgattttatgaattcagggtcattgtcacctttaacctatgaaagttattttacagagatgtttgtcttaggaagaaattaactagatttttcactccgcagccagaataatctatgagctgattttcttgtttattagtccgatggactctttggaaatatcagtgtcattgacattatgagaattgttaacaatattaaagttacacaaagaaaatgtctttgaaatatcaaaatatcatattctgtttcaaaatgtagcagtgaagaaaagagcggaacacagaattattagatttaatttatttgtagcttgactgtccccagcaagaaaatgtcatttaaaaaaacaaactttgggatatcctgtaaaactcaatcctgcataaagaaaatgcggtacaggtcgggcgcggtgctcatgcctgtaatcccagcactgtgggaggccgaggctggcagatcaccagaggtcaggagttcgagaccagcctggccaccatggcgaaaccccgtctctactaaaaaatacaaaaattagctgagtatgctggtgcatgcctgtaatcccagctactcgggaggctgaggtaggagaattgcttgaacccagaggctgaggttgcagtgagtggagatcgtgccactgcactccagcctgggaggcagagcgagattccatatcaaaaaaaaaaataataataatttggtacatatacagcatgaaatacaatactatgcagccacagaaaagaattagatcatgtcctttgcagcaacatggatgagtctggaggtcattatcctaagtaaactaacacagaaacagaaaaccgaataacacatattctcaataagtacgagctaaacactgaatgcacacgaacacaagggaacaaagagccagcagcagctagtgctggggaactttgagactcctacgtgataaatcatgaaagggtgtatggggggggtcttacttgcaagtatgttttgggaggttttttgggcacacatgctctggttgtacatgctagcacacataccacatctcattggcatctaaaatctccacccaggggtgtgtgggtttttttgtttgtttgtttgtttacactattacaatgagcaaaagaatagggcaagtttttggaggagtgtgtgcatgcttgtcagtggggaaaatccctagcgtggttatctctggcgagggcctgagaagtcccctttggggctagaggagcccaaccacaaggctagacataatcagtgtggacagtgtgtgtattcattgtccgtttcgctgattgtcaacaggcagcactgactcagtgaaacagcatcttcaggacttcttttctcaatggggctcccttgcctgctcatttctggctatctgcctactccaagggaaccagaaaaatcctggcaataaaacatatagaaggaaatttatatgactttgggataggcaagtatttatgatacctgaatccaaagcatgtttcaaaaagagaaaagttaacttggacttcatcaaaattgagttattgctatattctggatatgagccctttgttttgagttgcaaatgtattttccttttctgtggattacctttttactcacttcaatggttaatattaataaaaacaagttctccacttggatatagtttattctttaaaactttatatttttatgacctgttgaagaaatactggcctacccaaagccattatgatactatattaggttattatctatagaaccattatcgttttaccattttgtttttggatctgttttacctgaaattgattattgcatatggtgtgaggaataggttaagactcagtatttattttatttgaagtctaattaacacaccatttattaaaaataatgcttcctcattgcttcacagtactaagtgtgtcattaaaaatttgtccgtacatatgtgggtctgtttttgcacttcaattctcttgcattgttctctctctctctacacacacaaatatcatgtaatgtggagtaatgtagttttataatacagcctagtatctggtgaactaggttctcccactttgttcgagattttattggttattggccctttctatttttgtatttgttttgtaatcttttccatttacatgtacattcattttaagtatgattaacattgagttaaatctatagagaataactgacacatttacatatggagtatcccagtcttctgtttttcttgattttttttttaaattttaggttttctagaatgagaaactgaaattgaacaggaacacaaaaggtgttcacaaattcaagaatcatatttaagaaatgtttaacctcagcagtaacttgaggaaatttaaattagagctgtaatgagataccagtacaaaattaccaaaatgactgaactagactactaatgccaaatgttgatgaggacatggatcaactggaaatctcacaattaacttctggaaatataattcaggcaactaattaaagagttgggcatgatctactaaatgtgaaaatgcacatttcttaccacccagcaattctattgtagacatacaagttacagaaatacatttcccagtttgccaaaaacacatatatatgtgagaatgttcatagcagtttcatttgtgatagcccaaactggaagtgactatgatacattctcatgatgggatattacagagcaatgaaaatgaccaaatgatagctacacacaatatacaagatgaagtcgttaaaatgtatttgagtgaaataaatcagacaaattatacctactatgatttctttcaattaaatttcaaaaacgggcaaaatgtttccatgggtttaaaattgaagagagtggttaacttttggaaggagtaagtcagtaaaacgcataagagaatcttctgcggtgctcactgttccatgttttgacctgatagctgttacacatgtgtatttactgtaagaaaacgcatcaagttgtacacttatgtatatttttctatatgcatattccacttcaattaaaagaggaacttatgaagggaacttaaaacctccgaaactccacgggccatatatagaaatctgatcatagaccccatgttttctaatgaaattattaaatgaatataagtgaatataaaattagaatatgatgtcatatgaatctcttcagggaaggccacatttcttacagaaaatatagaacctcctaatgttttagtagggaaaaggccccaaaataatggcttaaatttgagaaggagttgttcaaaagcagatattaacaatgctttcatctgagctagagctttaatggggagctgcataagatgctggcctatgcgttagaggacaaaacctcaagacattctcatgcagaaaccaaacttggaacaaaggaacctttaccttagcctgtggctgaacaataacacatggattttcaaaagtaaatctaggctgggcgcggtggctcatgcctgtaataccagcactttgggtggtccaggcgggtggatcatgatgtcaagaaattgagaccatcctggccaacatggtgaaaccccatctctactaaaaacacaaaaattagctgagcgtggtggtgtgcatctgtagtcccagctactcatgaggctgaggcaggagaatcacgtgaacctgggagcagaggttgcagtgagtggagatcgtgccactgcactccagcctggccacagagtgaaaaaaaaaaaatgcattatcttataattctccattttgtcataagtataaacaaaaatggaaaacatccataagtacaactttagtttgcttattaggaagaataaatcaaaatgctcaagcaggattttttttctaaagttgagcttgggtgtgttctatatcaataagcctgtgcaggatataaataatcacattgaagaagtcctatccaaatttccttttaaaattcacaggtatataagttgattgattggtgtcagagcaaacacaaccctttgtgtgtcagagattacagccacatggtaggcaatatgaagcatatatacttaggaacagttaagtgaataaaaaagagatacatagaataagaggtctgagaagaccttttggttcagttcctatatgagcagagacctggagaaagggagtgagccttggaattgtctataggaaggtgggttaggcacggtaataaagaccttaaggtgaaaaagcatttggaatgaggcctcagcaagtggagtagagtgagtttagagataaaggaaacatagcagagataggggagcagagaggtagtaaggtgggggtgagaagaagaaagcatggtgagccattgttggcatttggactcaggtctaaatgagatgacaatgactaaaaaaacactactagaaattaaatgggtcataagtcaggttattttaaaaatcagtaatagttccaagtctttgctattgtgaatagtgccacaatgaacagatgtgtgcatgtgtcttcatagtagaatgatttataatcctttggatatatacccagtaacaggattgctgggtcaaatggtatttctagttccagatccttgaggaatcaccacactgtcttccacaatggttgaactaatttacattcccaccaacagtgtaaaagcattcctatttctccatattctctccagcatcttttgctgactttttaatgattgccattctaactgttgttaaatggtatctcattgtggttttgatttgcatttttctaatgacaagtgataagcattttttcgtatgtatgttggccaaatgtccatcagtgatagactggattaagaaaatgtggtacatatacaccatggaatactatgcagccataaaaaaagaatgagttcatgtcctttgcagggacatggatgaagctggaaaccatcattctcagcaaactaacacaagaacagaaaaccaaacaccgcatgttctgactcataagtggtagctgaacaatgagaacatatggacattaggaggggaacgtcacacaccatggcctgtcagagggtggggggctaggggagggatagaattaggagaaatacctaatgtaggtgacgggtctatgggtacagcaaaccactatcgcaggtgtataactatgtaacaaacctgcacatgtaccccagaacttaaagaataataaaaaatataaaacaggaaaaatcagacaaaatgaaaaatcagtgatagaatactaacaaacttagagtgtcattttattcaagaaagttacagtcaataacgaaaacgtatcgcacagtagaaatgctgctaaatccatgaagaaaaattgatggaaatatatttttagagccattaattcaccactgtcaagtttatgacatatttaacagcaaaagattgagagtacaaataactgtaggtttaatagtgattttctgtatctcaacactaaagcatagtagatacttctataaaatatgagcattatcaataaatctccctatgaagttggatgtgcaagaagagcaatagtttaaaaatttcagttacattaactaaattcaagtctgaactctcaacaaggcattcagaaaatcgtatgtctgtcattattgggaatgctctcccctgagcctatggaatggccagagctcagtagatccacatggtgtctttcatagggcaaaagcattttcattttcagttcattgaggcaaccaagtgatacattcactatacaattttaaggtatcttgtgaagtcaagtgtattaactgtcctgatattaaacacgtggcatacagaaaaagttgaagagagtgtaatcaggggaatatttatagaaacgtggggaggattaaaggaagaaactatggtgaagaatgcagggattcacatgagttaataacctttactacatctaaacctaagcagtcaaggggagagggctattaatttgataaaatccctcatgttgggagagcgccactggacacaactgtgaactgagcccctaggtatctaaagaatgctgttagtttcaaatcattgcctggtgaagttgagagaagtgataccttagtctctccatagaatcctccagtgttttgccagtgccgctccttagtttagtctaaccagaagtccaaggttaagagattccaggtgatgtagtcatcacatacaaagaagaggtgaagaagtttggtgggttagtgaagtaggagtggaaaacggtataatcggcattccaggtatctagttctgttttgtttctgtgcgaaatgaggacttgagaatctgcatgccgagaactctgatgttggctagggcccagtcttgttggatgcatcaggaagccagtcacctttgaggccataccacttctatttgatgacagagagtagacgtggtttctggctaatttggggactaaggactccttcctattcttctggagacaaccagagccagaaaagaaagacacgctgagagtcacttcggatatctgctcttcgtcgtaaacttgttaaaggcttaggaaaatagtaaaaaaaatttcctgccacatacacaaattataaacgggcaatatatttgaatgcagtgaaaatgtcattaaatacacacaaactttcaaaattcatgttatttaataacagtagaaactaataatatacttataaattaagtttgattaaggtttgttaaaccaagagtataaaactacatttgtgaaggaaaaagcattccatatgaaaacccatgagaaatggctcaggctgtactgagagtttgaatttttgtctttgattttgatcttcattaaaaagataaattgaatcaagctttcaaataaaaatgttacaaaaatgctttaaggaaagcaggaactaaagataaagaaatagaagaaacactagataaaatatacagctagttccttataatatgaaatagattaatatcttatgaatgtgatccagacaaggagggagaaaaacaaatgtatgcagtttaaaaatggaagggaaatattaagtatgagatatagaaaccaaaaacgggttttacacagaaatacatatatgtttattataaaaaatgaagttgaggccgagcgtggtggctcacacctgtaatcccagcactttgggaggctggggcgggcagatcacctgaggtcaggagttcgagaccatcctggccaacatggcaaaaccccgtctctactaaaaaaaaaaaaattagacgggtgtggtggctggcgcctgtaattccagctactggggaggctgaggcatgagaatcacttgaacccatgaggcggaggttgcactgagaggtgatcataccactgcactctagtctgggggatcgagcaagacttgtctccaaaaaaaaaaatttttttttgaataccagtgataagtttgtccacacaccaagaaattgataattgctaatagaaaatcatatgaacagcctcctaattctataaacctatgaaaagaaaccctggtttaaaaaaatcactcaaaatttagccctctgatttttaaaggaatattagaagtgtcttttcaaaatgatactttttggtaatttctggatcattaagtcaaggtcattttgtcttctctcttttccttagggtctcctccattttagcctgtccctctgccataaatcactagttctagcatattctgtagttctaaactagctcctcagtttaaccctgttcctcagtttctttcctttccctgtcctggcgtttaacctgttatcctcacttgaatgccactcagcttatatctgtagagctcagacactacgtctgtgttccaatttgcattctttgtggtggctgttttagcatgaagttatccctgctgtcaataatgtattttggaaagccacttattgagaagaaagtacttctaagtgcagtgataactttattgcggtatttgctgagagcaaagctcatttgtaatagttggttgtgattttaaaaagcgaacaaaatacaaaatcctgagaaatgggagactatgctactaagtggttattcttgtctctacatcagctctaggtaaaaatgtatccacagcttctttttatttacaagtttttgaaggtaaagcaaatcccagctaggatgaaacatctcttatacagccattctattatttctttgccctgtcccacttttgtttgtaagtagtgcctttcattaggcattttaaattcagttctacacttaactctattctctcaaagatatttaatgggtaatttaaactttccttggatataactaagttctaatcagtgagtattctctattagatatttgcacttttaataattttgtgtctagtttaatgattaattttttgtctggtaaaggaacttagaaattacaaatttgatagagatttaactgtggtgctttaaactaccccccgctccccaagatgtattatgatctgtcttcctttctccaagcttgtgtcctcgtcttccctcttatgatttccttgcttacattttatgaattccgatcccttttataaagattcatacaaaaggtatagtgttgaaatataccctaggaacattaccaagacttcgctgacttaatataatttaatattaactgacacagttgtagatctaataattatgttcattgtaccagctcatcaattgtctatcacaaggtggtaagtttttaccaagtaacttcaaatctacaatgtgggatactacaaagcaaatagtcattgctatacattaaatcacaaatccaaggtgagtatttaaaaagcctagggtggaaattcagatgacagctatgttcaaatattcacttaaccccatcattgaaaatagtcactgaattagattgaatggttgtcagatgtcactgatctgaaaaatgatatactgttcacatgctggcatataatgttagataaagaggattctaaaatgttctttaaaactagtattttatgtgtcctttaagtattcagaaacttaaatagccatataatacatattttggagcatgtcagaatatatttgactataaactacttctatttattactcataaaatctagtatttaagtacaaattccaaatttaatttgttagacaagtatttcttacacaaaattgtcagtccacacaataggcctgtaaaatatttgcactttatatgtattaattctcaagtttgcagaagaggtagatcttgttaactctgtaacttatcaactatagggtctttgccaaatgattccgtgactttgactcactttatcatctgcgaaatgcattaatagtaaatgttcacttctttcaaaatacttgttatggaagatacaaatatacaaacataatctcgtattcattaaactcacattcagttgcaaggtaatataactactcttaaattgcagcatgttctcatttaaaataattttctgggtgagttgtttattcttcccatcccccttagtatacctcttgctttaagggaaattagtattgacacatttcttgtatattcaacttcaaattgagatagccagttacctattatgttcacatatggaggtctgctgggataataattatataactataaatagtactgtttaaaaatatttcttataatgtcactcaagtatcttttaagatttttattgtagctattgcttttttttttttttttttacttgaaattagtatacgtgacttgagcttaaaaagttggggctatatgggttgatttttgtcgttaaagttacatcctatattgccagataaaagatacgtaattacaaaaattcaaattaaataatatactgaaagtatatatatctttcatactaaattgtgaaagtattgaggacagtgtccatttactcaggcaatgccctctaatatatattctatataaggaattttgttgagtttagttaaaagagctactttcccaaaaagtttagtttgcattttattaatacgttcaaccagattacctgtatcaaaacttctattttgataaatttgttttaatgtctttcatgccattaaatgttcatattttcttaggattatgagacacttgtattaactgcctcaattctttattgtcaaagaggcagtatataaacaaatgaaaacatgactccattaaaaataattctcctgcaatgtatcagagtgatcataaacatatctgaaatatagaggaaatttaacatttcacttgtccataagcaatttgttgaaagtctattttttaaatttattcttaacattctatgcgtggcatatagtgagtggtcaaaaatagttaaagaatgactaaatatgtaaaacttaatcattgaaggtagagatagtatctttgtagtgagtacccagaattaaatcttgtaatatagttgaggtcaaaatgtgcttcaaaaattatctaatgtaaatttctatatctgaatcaaaaataattcttgaaatacggagataaggaagggaataaaaagctgtcattggaaatccaggtccacagtggcaatatggcccaccgtttaggttgtatatatcgacgtatttatgatttaataagaaaaagattcaatacatgcatctctcaatggaagaaaataggtatgatttatgcccataagtcttgaaattttaaacagtgtaaatcttaaatgtggtgtaaaagcacatgctgcagggcaatgaaactactttgcctttcctgtattttttatctttttaaaatgcattatatttagaaggattgtatgaatacttgagaagtttctcttgaatatggagaagtctttagcttggctacatgatggcagacatcttataaaagacatttaacatgtttaaaaagcaaattctgtttatctagaatgttggaaggaacttctcggtttatatatattttatgagaacgaaatgaaatgaaaagaaatgaaagaaccaaatagatggtggaagtacatgcttgaggtttcagtgtcaggaaggatatttacataataattttcaatgcatgggatttcccttttagttattgtttaagattctgtttaaggaaatcaactcaaacttttaaggatatttcagggttcctttcagaatctttttgtgaaattattttataatagtttgtaccatttcatatctagttaaaatcaccaagactgagtgaaaaggtagcttacccttatccccctcccttagctaattttaaaaatgcttgtattttacactgcatatgagggaacaaaagtgactccttcttaggacaaatatcaaactctgaaatgatctgggagaaccaattcctttgaaacaaatgtgagaaacgacctgctttagtctaatttcaattggctgaatgacgcaggacgtgttttcattagagcctgtagctctgaaatgtccttgtcactggttgtctaaaaaggcaagaagaggcagacaccatatattataaagatgatggttcccctgtgaatgagatataactttctgcaacttccaagttaaaaccgcaaatgcttaaatgatacacaaaactctaaacatccatctctctctgcatctaacaaaaataaaattgtatgaaaaaattcattaaagctttgtcagaactttgtcacctgtctttttctctctctcatacacaaaccacacatcacacacacacacacacacacacacacacacacacacacacacacacacgtaaatatcttacaggaatgtaactcttagttttattcatcattttcccttctctctctccttctgctctgccctaagaacttccattttcattatttgacttggttattgaaattattttcaagttacatgcccctcattctgacgtcttatttactattttctgtttgatgaaccctagtctgctattcttctttctgtaaagcaaatcaaaaataacactaacttgttcctgtcaataatctttcagaaaaccatcatatttcaggtttactttcatcttaagtttttcttaagtattcttaaatcttgaatatatcaatataataagtataaatccttttactgtaaaccatcatgggatatctaatcttagcttgaataaaatattgacgatggtagaaattacatccatgttcctgaaggaaagtgggataaaagaaaacagcgaggttttttgcctgtctcgaacaagcaaatgacgagaattgttcctcatagcccagtcatttaggaggtagagtacctggaagtaaatgctccctgaaatgattatatattaatcttagaattactaaatatatattgttatacaaaattatgtattgtaagtactagtctggcgatagaagagggacccccttaagttcttgtcctatgcctttaaaatagacagcaggagactactccatactaaagaataatttaatgtattaggttttctatgtgcaattcttacagactgcttattgtaacttgaggtgtttctaaagagttcacattttaatattctactggagtcacaataagtttccattatgtcaaagcaaaccatggaggttttctatcctccaaaattacatttgaataaagcaacttccgaagataacagtgtaaaactctgagacagcatcccatgttactttatgagtaaaatcttaggcctgttgacaggaactacaaaagccaattgtgctgcgtagtttaacttatttctgcaaaaactcaaggcatgttattacattttcacacagaatatcaattttcacacctattttggtatcagatgttttcattgtgcaaaacaggaaagcagaactttgggtaaccacagtgaccctactatttaatttccaaccatagagtgcttgtcacaacactgatacacacagtaggctcgtacattaacatacatgtcatattaatgttttctgttttgcttagtagacagatgtaatcattcacttcacacagattttaaaaggttttaatatttttaccattcagttatttagcaattagactgataattcttgaaagacataattctggaatgtgtattagaaaaaaaaacataaaagagaagttactgtatggcagggtgatgattatttaagaggaaatagtactgaattcagaaaaatgttatgacttacagctaatagtaagaaatacagcattataagagcaacaagcttatgagaattcatggccaaaacagaccagaccgtcaatgtgaggcattgaagagtaatataaatgccatgaacaataccctttcaggcatgacaaatacctccctcctctagagtcttcatggttatcaattagcatttcttacactccttggtagtttgaagaagacatgtacaagagacaaaacacaaccaaaataaataataatccttgtctgtatcatggtgtgaaatgtttattaacttggagagagagcctcttaaagctttttgtggagaattcactagatgtaattaatgaaatatcttctatccagacatagttttaaatcagaccttgtggaagcttcatttatctttgatactctgtttccctcttggtaaaatgcacataaatgtaaaatgttcatgaactcttggtaaaatttatatagctcatacatactctaatgatgtaggcatagtgaaatctgtattcagagagaactgtatagccataagatttttaaaagatggaaataaaagaagtatgcatcttaagaaattgtaaaaatagaaacaaaaataaaaattgtattcaacgtagaaaattgaataagaataatccattcaaaagtgagctcttgaaaagattaacaaaataggtaaacctatcccagtcataacaaagaaaacttagaataaaaactagacgagataaatgagaaaagacgcatgacagcagatacagaagaaatgaagtggaaactaaaagcaattttataacaattttgcaaaattctggaaaacttgattttctcgtacaatacaaatcactaaaattgagataagaataagtggaaaattagactgattacttcagaaaacatttagtaggttattaaaggtgtactgttgaagagtgtagtaggattctttacaaatgaatttaacgtaacccttaaagaataatttatatactttaagctattccaaagcatatgaaaagaaaaaaactccacaattccttttgtgatgtcaggttaacctttgtacttaacagtcaaaaagcaaagatcataaatctgtaagacagttttacttttgaatgaaatacaaaattttgttgaattataagaaatataatcacattttgcaagtggtaagcattctacaaatgttatctcttatttaccaagagctcttaaaattcaagaaggaaaagaaaactaccatatagaaattaatgagcaaaacatattaacagacaattcacacatggaattgtaataggtcagtgatacaaaaatatattcaaatgcacaaggaatcatggaaataaaagttaacaaagtgatgtatttgatcatacaaacaaaactaaaagaatcaaaaacaaaacaaaaatttcctggtgagagaagagcctattcttatacattctggttaaaatatgtaattctaaattgtttctaggaaggcaggtggaaacacctactaaaattacatatatatgtgtatatatgtgtgtgtatgtatatatgtatatagatgtatacatatgtatatatgtgtatagatgtatacatatgtatatatgtgtatagatgtatagatatatatgtgtatatgtgtagatacacatatacttgtatagatatgtctatatctccctgaaatgatgcgtatatatatatgtatagatgtatctactagagcagagtgtgtgtgtgtgtgtgtgtgtatacacacactctgatccagtatatacatcctgtgaattgttataataacagtagaagcatcagtatctgaaaatgtatgcataagatattggccaggtgtggtgactgctggtgggaatgttaatcaattctgccattgtggaaagcagtgtggtgattcctcaaagaagttaaaacagaaataccattcaacccagcaacctcattatttggtatatacccaaaggaatataaattgttctacgataaagacacatgcacatatatgtttattgcagcactattcacagtagcaaagatggggaatcaacataaatgtccatcaacagtagactgattaagaaaatatgctacatatacaccatggaatacaacccagacaaaaataagattgtagcaacatggatgcagctggagccgttatccttagcaaactagtgcatgaacagaaaaccaaatatcacatgttctcacttataagtgggagttaggctgggcgcagtggcttatacctgtaacctagtactttgggaggccgaggcgagcgggatcacctgaggtcgggagttcgagaccagcctgaccaacatggagaaaccccgtctctactaaaaatacaaaattagccaggcgtggtggcgcatgcctgtaatcccagctacttgggaggctgaggcaggagaatcgcttgaaactcgggaggcggaggttgtggtgagccgagatcgtgccactgcactccagtctgggcaacaagagcgaaactccacctcaaaaaaaaaaaaaaaaaggggagttaataacaagaacacatggatataaagtggggaacaacagacactggagcctactcaagagtaaaaggtgggaggagggagaggatcagaaaaactacctatcaggcaccatacttattacctgggcgatgaaataatgtgtacattaaacccccatgacacgcaatttacctatgtaacaaacctgcacatgtactcctgaacctaatataaaagttaaaaaagagtagctgtctgccactgaatacaattctgtccctgaatataatatctccaattcccaatcagttaattaccccctagtgatctgaatgctttctggcatgctttctccacctgatacttttcttcattccaatctattttttctttacagatttaatcaatactgagtacatgaatatatcttatgtcttttgcttatcttttcacaatgttacttcctttttcttaccccttgggcttccgtgagacacagttgcctacctaattgtttttcctgtggatatagataaattttattggaaaaaaaccatgaacatttatttaggtattatctgtggctgctgctgtgtgtgtgtgtgtgtggggggggggtgcgatgtgtgttccaatgacttattttttattgtggtaaaatacaaatgatgtaaaatttaccatataactattttttattttttaattagcaaaaaaaattgtatataccatgtagcatatgattttttaaaatatctagatgttgtggaatgcttcaagctaataaacatatacattaacttatatgtttatcatttggggttgaggacacttaaaatctattctcttagcaattttcaaaatacaatattgttattaaccaaagtcagcatgttgtacagtagatctcttgaatttattcctattaaatgtaatttagtatcatttgaccaacatctgcctaaccctcctcctccaagctctatcccctgctaaccaacattttactctcaattctatgagctcaacattttaaaatttcatatacaagtgacatgatgtaatgtttgtctttctgtgcctggcttatgtcatttgacgtaacgtactctagattcattaatttcattgcaaatgagaggattctctgctttttaagtccgagtagtattccagtgtgtgtgtgtgtaggtctgtatacctgcattttctttattctttcatctactgatggacacttaagttgatttcctatcttcgctattttgagtagcactacaatatacattgaagtgcagttatttctttgacatattgatttgtttcctttggaatatatacccagcagtagaattcctgaattatatggtagttttatttgtaattttttgagaaacctccatactgtttttcatgactacaataatttacatttccaccaacactgtgcaaagattcctttttctccacatctttgccacaacttaccttttgtctttttgataatagccattctgtgtgatgtaatatttcattgtagttttaatttgcatttctctgatgattagtgatgttcaacattatttcatttatgtgctggccgttggtttgtcttcttttgagaaatgtctattcaggttcattgccctagatagggtttgaggtatcattttttctatttttttagtgtataattcagtggctttaagtatatttctgttgttgggtagtcatcaccgctatccatctctagaatgatttcatcatcccaagttgaattcatactgattaaacgattactctccattttcacctcccctagcctttaataacttccattttttctctatgaatttggctattttaggtacctcatataagtagaatcatacaatatttgtcattttatgtcttgcttatttcacttagcatatgtttccaaggttcatttatgttgtagtttgtatcagaatttcattcctttttaaggctgaaaatattccgttgtatgtacataccacattttgtttatccatttatctgtagatggacatttgggtgttctcacattttggctattgtgaataatgttactatgataattggtctaccaatatcttaatctctgtttttaattattttggttataaacatagaggtagaattgctagagcctaatggtagatacttttttattatgtgaccttctgttgtgaactttttgacactgggggggtagtaccttactttcctttatcaggtctgagcccagtacctgaatatagtggaaattggaccttatgagaccttttatgaggacaaggaaatggaggaactatcttcctgcttacacagtgacaagtcttatgacagtggataaggggttactggaatctaagttcctattacttgatctaagtctccccagagtcaggtccatggcaacccaaaacgtatctaccagcagtgcttcccgcagtatgagtgagtatgtttcctaaaaatagcatattctctgcttaactgcttgagtctttagtgctatatcatctgattgtcactatcactagaattaagtttcatgaaagcagaaggtttttacttttacatgctcttattacttcattgcctggcagatagccaaaaggtacttgttgagttagtgaatcaatgaatcaatagataaattcatagtggcttttccttatggaggaatttctctcctctactgccatatgaggaatccccagatgatgatgcagatgatgatgctttcttattcttgaatgatcaatctccccttcgatgtagtaacatcttataaaactaaaatacgatatcatgaccaagatgtcaacattcataaaaccaccaatagtattcagattttcccagctttactcatatttatgtgtatgtgtgcatgcatatgtgtgtatttagttctatgcaacattattacgtgtgtaggtttgtaaatccaccatcagagtcaatatgcagaacagttccaccattacaagggtccctcatattgcccttttataagaacattcagctaccccacatcttactcccattcctgacctctgccaactgctattctgttctctatttctgtaactttgtcttttcaagactctcatagatacggattcatacagtatgctaccctttcagaatgactttttccccacttagcataatgcccatgaaattcatccaatttgctgcatgtatcaatagtttgttcttttcattgatgagtgttattccatggtgtggctgtactatggtttgtttatctacccctgagggcatctgggttcccagtttggggctattacaaataaacgtagtatgaacacttaggtgcaggtttttgtgtacacatgtgttttcatttccttgagataaatgctcaagagcccaattaccagattgtataataagtacatgttcagttttgtgagaaactgccagactgttttccaaagtggctatatcatttgagtttccactagcaggggttgagtcatccagtttctccacaccctcaccagcattttatggcactattttttaattttaaccattatgataaatgtgcagtgatacattattgtggttacaatttgcattcctctattggctaaaaacattgaacatcttttcatatgcttgcttttcagatgcttgtgtttaactttactccaccttaaacatttgaggagtgtgaaggacaggagacacagagatttgccttgattaaggcaaataaaaccctgccagattttcatttccaaacacagtcctagacagagataagagagctggcagtttgctccattgtttattagagacctaacattcattctaaaacagaggcgttttactaaaatgcagtcagccttaattataatggcactccttggagctaggtggaagtactggtgaatttttctgagttgtaattccatactagaaagcatatcttaattttaaacatactttatgacattttatttggagatactccagttgacctctttaatctgcagtaatctattcatgtgctgaaagtaaatatatttggggtgcttgtttgttatggaaagtgattttacacatgcattttgtttaatttttagattattttcaaaaagcttcaatgctaagtctctgaaaatagctaaatgcaattaccttcacgtttttattattattattattgcaactaggcatttggtctcttaccttcaaatgttttacccctttctttaacaggttgatttagtgaatattggaagtactgacatcgtagatggaaatcataaactgactcttggtttgatttggaatataatcctccactggcaggtaagaatcctgatgaatggtttccttttgggtaacattaatcttgttttttaatttttacccttgacgtgtgaaacaaatgtgtatttctaacaataacaaaccctgctccatagtgctgctttttaaattgacactaccatgtcgtctgaaatgttaaggatcatcacggtataaaataggttctggtacatttacaggaatatttttcaaaattttatttcattgagtaagtataaggtaaaaatacaaagtcccaatcataggtgagtaatttttttcacaaatgtatgttctataacttgtctataagttaatttagtatgttttattttaatcactaccaaaggaatgaggctttctcagtcttgggtattcttaacataaattattgccaataaaagattagtagaatatgggtatctctatcaataaatgtgtgtaatacatacaaactccataatgtgatttggaaattatttttaagtcacctgagcatagggtcttccgactgtctatttgacctctgcaaaatgggttgaaggatttgtggaaaagatacagacacacacccgtgtgtgtgtgtgtgtagtatatatgcgtatatatataatgtgtctatatatacacacatatatacaatatgcatgtgtgtatatacacacactcatatccacacattatatatgtatatatatacacactcatatccacacattatatatgtatatataagaccaacatgaacttatatccactaatattatccactcattgtatacatatacataatagtataatcataatatgtatacataatcatacatgaacttatatccactaatattttccactcattgtatatatatacgtaatagtaactcgttatacacatatgtataaatatgtatgtgtatatatatataccaacatgaacttgaatttaaacttccacggttaccatcttagtggcatttggtatattgccacccctgttctgggccatggtcccttcactatcaaaagagtaaaaataaaaataaatgtgtatgtatttcttatcacgattaagtgggagaatatctgcaaggcactcagtgtagtataccacttttatttgaggtgtatcatatgacttgtattgattgcttaaagttttccactcatttaaaaaatttggaggctgagaaatgactgctgtttttactggtcgggattacttttttataaatcagcgtttttgaaatgtaattgttagaccatcaatgtactcattctaagtgtaaaattcaatttgcatcaatctggtttagttctggttcttggtagcctctcaaactattttgagggatgaataactcccccccaccacgttcattaaaatttgcaggatatttacagagttatatagccatcatagcgatctaattttggcacttttccaccaccttaaaaagaagtttcttctccatttacagtcatttttcactcccaccccagccctaggcaattgtcaatctatttctgtccatatgtatttgcctttttggatattttatatcaatataatacatgttcttttgtgtctggcttcttgcaatgagggtaatagttcagatccagccctattgtagcagatatcatggcttcattcggtaaacttgaatttttttattttttatttttatttttttttatttttattttgagacagagtcttgctctgtcgcccaggctggagtgcagtggcgcgatctcggctcactgcaagctccgcctcccggattcacgccattctcctgcctcagcctcccgagtagctgggactacaggcgcccccccaccacgcccggctaatttttttttgtatttttagtagagacggggtttcaccgtgttagccaggatggtctcgatctcctgacctcgtgatcctcctgcctcggcctcccaaagtgctgggattgcaggcatgagccactgcgcccggcttgaattttaacttgaattgtagattgctcttgctcagagtcaaatagtgagtagacacaaagagtacctattaaattcagcagccatgttgctctcctaattggcccccatatatttttattccaaattctctgaacaggcttaatgctacttcacaacagtaagcggggagaggggaagagaaagagcgggaattaatatgtgctggcaacaaagaatagctcataggagccttaagtgagcccaagttggccgattttcagcccgttccatatagtgatggtgtcaaatagaaccagcaagcaacataccgcatctctccccaaactgcttttcatatgttgctcagtacttctcaaaatatcttgaggaaggaacacttttcccctaatccattgtatgtaagatagaataaaaccaaagcgttacaaaaataagatgcccaacacccatgcttcctcctttattattaaatacattagacataaatggtactctgtaaaatcgctacataagtttcttgatgcactctgaattgttgactttatcttatggcatagtaacaaataattcctagagtgaatccagtttgcagatcccgctttgcgtaagacagatgtaagttttgacaaagccagcagaagaactcaagcatgcacagagctccaaaaggcactctgaactgtatttattgtttatactacttcttatatgatcttaccatttttaaaaatatcctgaagccctttccaactccatctgaactagtccaagataagctttcaagactattatgtctgataatttcttcacttgcttgcaagttgttcatttattattatttttttattttttatttttgagacagagtctcgctctgtcacccaggctggagtgcagtggcgcgatctctgctcactgcaagctccgcctcctgggttcatgccattctcttgcctcagcctcccaagtagctgggactacaggcgcccgccaccacgcccggctaattttttgtattttgttcagtagagatggggtttcaccgtgttagccaggatggtctcgatctcctgaccttgtgatccgcccgtctcggcctcccaaagtgtttggattacaggcgtgagccaccgcacccagcccatttttcattattagcatgtggaggcgcttttgcaatgaggaatatcagaaggaatgctttttaaatctttctttgtctgagacctctcttatagcctgttgtttttcatttatgcccttgaatcaccatatccttgagactgcaagactgtagactcttcccagcctctgcttacttatctcatctctcttatatcacactgccctgttctaaaactattaagcacactttgaaaaattatcttgctcagtgttcatcataatccagtgaatctaaaaatgtgtttttcttttttttttttttttttacaccaacattacatattttcttcctattaaatggtagaagcccttgaatttcagcaaagattaaaggacattttggtcaacttaatgtacattctagatctatcagataacgagcggcatttacagatagaaccatgttggcccctttttctaatgcaacatactatgttattaatagtgccatggaggacttctcattgaacttgtgaaaactcaggaatgcaaactctgttttcctattactgtttttctactgtccatctcaaataaaattgctagcctaaaacagtaacgcatattttgtaacataggcaggtttgaacaaaattgcaaagcatataacatgtgtttggcatctttttcttccttcttaagtgcaattctttttttttcggagtgctaaacttggctctggcaaccagctggttgtaataacaaatcttgctaacagtggtgagctatcagaagtcaggtccatacttttactggacaattcaagggatgtacttaatggcaacgctaattcactttagaatgttcatattattgatacaatttgcaattacaggagaatgatgacgttcgcactgctgaaagccatccctgtaaattcctgcctaccaagtcacttctgtgcaagacagttcttgctctgctcttctgcagagcttcacagaaactatccttaccatataagattattcctaccctcttcatttctattcctctgctgcaacttcttttaatcacagtctgggttctggggagtagacttcggagttgagtttggcaggcagcatgtttattaagccatgccctggaaaaaaaaaaaaaaaaaaaaacacctgtagaagggcagaggtgacaggagtggaaagaggaagaactagagctgtgacgtagaccctatgacacgcttattcaaaccccatagacaacttgcagctaggatgacccctcagagttgtctcaaatggggttaaaatggctgagtgtttatactctgccccttcatcagtcaatagtagtgggttgccctagagagggtgtgacattggctggcaggactctgcaactcaggtggtacctgagagaactaacaactagaagctgcctgaccacagctggagcaacaagcccttccttgaaggtcaatcttggtggtgcacctccatgtccatcatgccttcttggcccagttaactcctagtcatttttaaaaatcactgctcaaagacatttcaacttttttccttttaaaaattgatttatagttgtatgcgcgcacacacacaaatacatctgtttaaattgagcctcctttagagacagtgagacctgaggacgggacagttttctgtttacaggctcacctttggggaccagctcaatgattttttgataactgccttttatgtaggaaaaggagacatgattatcatacattgccctttattatttttttttgtctgagcaacatttgcacctaagtagaagcaataacagcgaggctgaggctgataagctgaattagtgacataatgatgctataaaggagttttggattgaatactttgttgtcctttaacgttatgcacatagagggcagactggccaagcatttcacaaatgaatcacattcatcattggaggattgcttgattattgcaaatccattaccaccattaagccactatctgctgattccaaccgtaatttagcacaggacacaaaatacacctcctgcagtcactgtacataaaggttgagcaatttataattttagaatatgagacaaattacgtaattatttgacctgtattcactgagtaactgactaaataagtaggtcaagaaggaattaggaaaacttggataatccactcctaaataataggcttagttatcaagggattgtgacagatacatgcaaagatttcatatctccgaatcgttactgtgtttacaaagcatcatctcaaatcttttaaaagtatgttaaaatgagatttagtagtatatcctaaaatttgcatttactttttaataaaaagatgactaacattggagatgttaaaatatgcatttaccccaaaggcatttgttaacttctatatggatgaaaaaataaaattgtcatatttagaatgcacaataaatattcatcatctgatcaaatgttgatagtatatgaaccttaaccttcccagaaggaaagtgcttagtggtacagactgatcacttttacatagatgtcttcttccagcatctcataaggggcttatatttaaaaagcagtctttaataaataataattctttaataaaagatgtagacagttttttctatgaagcgtcactgcattcatgaaacttagaaaaaatgcttagaatggatttctgcatcagatgactcagaagaattaaacttgataatctgttgaataacatctgcacatgcacgaagcctatgagacaatcaaatacatggaaaccaagtaatgaaaatagaaccaaggctacatatgtacacctcttagggataaatatttccttcctttgttgttttttttctttattttaggtaggcaaacatttctgtcttcttttcagttcagccaataaatatagcttgcgttaaatgatggtatgaaatcaggggttttatctgaccatattttgtactttgatcttacactaaccttgcatgtaagatacacagaaatgaggcctagaagaggttaagcaacttgtccaattaccacaattaatagcaaaggcaaaatttgaacatatactttaaaaaacaattatctatagtattcctcctatccaaaaagcgcttttatatcttaagtccttggttaacaataagtctaatgttttatacactgtcttctctagcttgttcattgaaagctagaaggtgagcaattctataaacagtaaatgttgggtctaatatggcagaatccaggagtaatagtgaacacattcagtaaatggtatggcatagataccaatgaatcagaatagactcctagcctttgagaatagacttaacttctggtagaatctattatgtctcattactaattggccctaaaatttctatttatcactgaagatcaaggacattcatatttaagtttgcatggttcttgctcaaggaatgcattttcttatgaaaatttatttccacatgtaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggtaagaagattactgagacattaaataacttgtaaaagtggtgatttagactctgatgacatatttttccccagtatggttccagatcatgtcctactttacaacatgttatgtacattgaccacattgatctaacgttccattggaatgaactaattaagaatattttccagtgttctatgggatacatataattcagttgttgaaacattaacattagcggagcgtgaaagtggttatagtggagggggagagtatcaatatgtttgacactgggaatcccagtaaatccaggttgtattctaactttgccgagaatggtgttggtctttttatacagataatgtgtttgtataagcctaaactatacaggtaaaaatgatactagatctcatgtgagtagttgtagttaaattaattaccatcatcagatacgtagtgtggagaaagaaacatctgtcttatcagatacacactttgatatcaaacaccataaagccctgtatactttgttctagttcagggtcataagatgctcagagcatttttagtaaccaagacaaagagcagaacacaattaattatatgacacaatgttttgaataccaacagaaacaattgcactggaacagcaaatcaattgctataaagcaagagagagatcttttgtggattttaataaaaagaattcactgtaatacagtgaaccaaagtccttaactatattccattcaacattatatttcttaagatgaaaaagattttttttgcttttcttgtgtaaagttcagtaaatgaattaataacagttcaagaaaaagcaaagcagtgtaggaaatacatatgtatatgtacacatacacttagagatacaatatatactatatgccatatatactacaccatttatactctatatatgtatatatatgtgtgtgtgtgtgtgtatatatatatatatatatatatatatgcttgtgtgtgtgtatttgagagagagggactacagtcactttattttggtcttcctgttacccgtttcatttacccaacccagggctaaatgcattgcctaattaactgtttaaaatgtcactggactgcatcttgcctaattttcagtgcaagttatgttttctcactttgatttttttttttttttgaccactctaccattttcctatgccaatcctgcttctagaaaagctaagaatattaattttctctaaggtaaagctcagtccaagagcaaacacatttcaaataagcatctttgtcaggtgtcttgctccagctggatttaattaaccccatcccgactgggtttccaggtgaattactcagcaacctgatttagaacagaggcagacatgcattcaaatgtcacgttaagcagcgttaacacattgtttctcgtatgacagaagaaaatgtttccacagcctcaatacagttagatgagaagggatagagacattctgtctgtgttttaagtcaatgctcatttatgcagccacatgcttaacactaagggcccgaaaatattgattttgctgttcatgtacacatttgcagatgaataaaaatatcaaggatcaggttatgtggtccttgttggctctctaacgtttttcccttcaagtggaagacttcaatcctgcaagcatgttcccactctatatttgttaatattctatttaatgatttctgaatacatttgtaggtaatacagtaaacatacccaaattgccctgttttatctgtccctgacccactctttctctgtcaaaatatcctcatttatatactctctcctgtcatattggatgaatcatcagtaactctctttatgtattacatggttacttttcaagaggttcttcacagttgtttaatgttctttcatgaatcatctcccccttctttttgtatttggcagatgttcatattctttatctaaagaaaaaaatggttgaactctctgttccatagcgattgtcgttggcacaattaggaatgtcatgaggtgccctcatttcaataattgagtggttcaactatacagaacaaagacatgtagttaatatagagcataaggattgactaagtgtcatggcagttaaaagttgtgtgataaaacgcaaagtccactacaatacccttcaaaggaagccagatttctactttttgtgttaaaacccaatgataattgcttagaaatatgtacaaaagatgcagataaaattacaataactataaagttacaattgtcttcctaaatccttattttagtgtattaccacagcaaattagaagcaaatgaacactagaatcaggagcaaagggaaaacagaaacacaatgtgtcttcatgaccccaatcttaacttaccttatttcaattcttagatgcagtcactgtcagctacttgtactttggttcctgctggttataataatatgtgtgataatgtttctacttgttgacaaactaatttctaacagtataggtatttactccatagtatgaaaaccagccatattatgtttcatccccaggtatttcctaattttattacttataatcattttatagttgtaatttttgcttttattacattaaatggtatgagtatacctcattttaaatttttaccaagtttagaaaggaacttttgaccaatatgaaaaacgagaaaatcatcacacattcttactctcgcctcttctccacctcccatttcggattacattctgtttgcatcagtagtatttgtaacatttatatcagttctgtaaagataggtgtttttggcttgagtctgtaaattgaaaatacatcactcttcttatataaatgtaattaacattacagcaaaataatagaaacgaatgtttttaaacaattattattttgtagacaccgttctaggtaaaatattcaatcaagttccatgacgtagatgctgtcattttacccatctcacaaatagataaattgagtcatagagaggttacgtaatttacctaaaactgtttggctaacatgtggtagagctaggatttaaatttacactatcctaatcatggtgttgatttaattaaaaatctggtgatccttggttgcaagtcaataaattatggtccaggttaacattaaatgctgtgtgggtttccttcatagttggttagttttacaatttttatgcatttgaaagtcatagatatttaaaatgttaattaattttaatagtataaaagaattcaattcatttttaatgctagacgtgacctcaaaggccttttggttcaatgctttttgaatgagaatgccaaagctcaaataaattatatgacttagataagatatccacacactcagttggttagttagtggccaaggaaatggggaaggtaagacaagggaatacagcacgaatgcataagcaatgctcttttttctcatcatactcaatttaaccttgtatactatgccatagatgagaaaactagtttctcatatgttcccacctatgtcctttttttactcccattgcctacagaaaaaaatgaagataaggcagagtgcgcatagtgaacttaaaagtcccctaaatattctacaatttttaaatttttttatatatttttcataacaaaggcattatccaatttgtaaataagctagtttccataagcttgttagctgttaggggtattggaaaatatggagggattcgatttcctaataattgtaaaaattctggtgtattaactagagtagaagcaattaagaagaaaccaataaacctatacctttatttatgtatttttttgagacggagtctcgctctgttgcacaggctagagcgcagtgggccaaccttggctcactgcaacctccacttcccaggttcaagcgattctactgcctcagcctcctgagtagctgggactataggcacgagccaccatgccctgctaatttttgtatttttagtagtgtcggggttttaccatgttgtccaggctggtctcgaaatcctggcctcaggtgattgacccgtctcggcctcccaaagtgctgggagtataggcgggagccactgcgcctggccaattttgaattacagttttagaaaaataacagctaaactacctttgtaactttttttttgtttttttcgttattttgtttttttgtttttgcatagcatgagctcttaaacaggagtccattaatagattcaaatattctaaaactgtatgtagactctgttcacagatatggagagtttttttgtaggagtagaagtttcatagctctcaacagattctcaaaggtgtctgtgattcagaataggtgaagaaccacttgactaatgacttccagtgctgttgggataaattataatacgttaacagccaacaccttatgcaaactcagccagtttctttcttttaaacctatctcccaccacttgatacttagaatcttccaatggagccaggcctgtgaggtcttgattatctgagcatgttttgcttttttccttccctaagaactttaattctctaacgctcacacaacttagaattctattatcaatacattttttttaatgcaagtcgaaacgtctatttaatctgtctttcagcctcagaaaactttcttgaccgcttcagattttacaaaacattttcttattgtctgtgttttttcacatttagagtttaattaattcatatggcttcttcatttttcttgctcattaaatttaaaatccttataagacaagaactgcctcttacactcctttgcattttctctattatcaagtaacatggtatgtaagtttcatgtgctcatccattctctcgtgtagttgataaatatttgttgagcctttattttgtgtcaggctaggtttccagcagtgaacaaaataggcaataaaagattgtacattctagtggaagagaaagatacacagagaaatttaattaaattatataatacgttaaatagtaagtgttaatgagaatagtataaagcagataaggagaaagaaaataagtatatgtgagtttgatttgaggcatgcagttttctttcatttatctatttaggagactggttcttcctcagtcacccaggctggagtgcagtggtacaatcatggctcactatagccacccaggctcaagtgattctccaacctcagcctcctgagtagctgggaccacaggggcatgccagcacacttggctattttttttttttttttttaataagttgtagagaccaggtctcactatgtggttcaggttggtctctaactcctggcctcaagcaaatccttcagcctcagcctcccaaagtgcttggtttacaggtgtgagccaaggtgcctggccagcatgcaattttagatagggcttgggcagggaagaacttatcagtgatgtgattttcgagtaaagacccaatggaagtaaaggagtgagccatgtttatgtcttcgaaaagcgaattccaaatccaagtgcaggaaactatggatcctgtttatggaatatgaggaaagagacaagaaataaaatcagagagttaatagggacctggaccctgttggacttcgtagatcacatgaaatacgtaatttgtacttcccctaaagcagagatttgagaagacggatatgatgaaacatgttaacagatcactctggcaactctgctatgcactaattaacgcaggcaagagtgagagaagagttatgaggctattgtgataattcatgcaagataaaatggattttggactagagtgatggcagtgaggatagtcagaagcagtcaaattctgaatacattttgaattaaatgttgtgtgagagtaaaatagtcattaaggatgactccaagggtttttatctgagcaactgcaattttaaacacattgttcattattgaggaagggagaacagcaagaaaagtaggtaggtttgggggagtatgatgaggataaacatcagaagctcagttcaggacacttgaagcttgtgattactaaatggagataatgagtgtttagaagaatctataatttgaagtttagggaagaggtctgggttagacatataaaactgggcattaccagtaaatggctggtattgaaatccacgagactggatgagatagataaatttttgttgcttggataagctagcgtagattatttgtcatcttcaggattttcttttttccccacatctttattgctgtataattgacaaataaacgttgtatgtatttaaggtatacatcctcagcattcttttttgatacagggtctcactctgttgcccaggctagagtacagtggcacgattatggttcactgaaccctcaacctccctgggctcaggtgatcctcccacctcagccttctgagtagttggaactgtaggcatgtgacaccacacccagctagtttttctttctttctttctttctttctttttttttttttttttttttttttttggtagaaacaaggtttcaccaaattgtctaggctggtcttgaacttctgggctcaaaggatctgcccacctccgtctcccaaattgttgagattacaggcatgagccaccacacccaatgagatcttccattaaaattattacttgtttaaatagaaatattttaaagggtaaatgaattacactcaagacttaaggactatgggcattggttgtcaatgaaaattaagcatggaagtaaatctcatggaacattctagattgatttatatttgtctttgtgtatgtgtgtatgtgtatgtgttttaggccagacctatttgactggaatagtgtggtttgccagcagtcagccacacaacgactggaacatgcattcaacatcgccagatatcaattaggcatagagaaactactcgatcctgaaggttggtaaatttctggactaccactgcttttagtatggtagagtttaatgttttcatctgagacttgtcatttctacacaaaatacaaaactacatatcttaagttttccaatactgtagatatatttaaaatgttcagccttcttgcactatattatgaattgtcttatttaattctagttctcaaaataccagtatctaaaattgcagtgaagacttttaggaaaaaagcctttaaaatgtgtatgccctatggatggagcatactgcatttggagtgcattgactccaaataattataaaaagttaatgttttgcttatgctaccaagagatttgatagagtaatcagctataattaattagctactcttgccaatttcattcatatactctataaaaggcaacatggtttactatttaaatcaggaaatctattcctgccactacttctgttgtaatttttcactctggggagatcctctgttggatggttactcattttctgcttctttagttgataggcagaagtgtatttatatttttattacattacacttcaataactttgactcttatctctggtgctacatagtcataccttccagacgtagagattacagagataataacactgtgacctctactcttcttctagcctatgaagtacactttttgccatgccaattttgaaatggtagcctctgttctcaattctcaaggctttactacactctaaaatcaggagttggaaaagtgaaatcggtgggattgaagatgatatttgggtagaagctgttctacaatagaagctgataattaaatgcttttgggaatattaaatcgatttcatcaattccaaaacaggagatctttcaatatggatggtaggtcccatcaagaaaactcaaaaatgacccagaagacagccttttgccagtgaatttattatcaaccagaatctagtactcagttttgcagacgcagaagcctgattgcctcagatcatctagcagatccacattggggtgggaggagttaactttaagtttaaaaagtgatatataaataaaaatggaaattcagtaatcttaaatgagatataacaagcagcagaatattcacatacaattgacaaatatattgctcttgataagcacatgtacttgggaaagcaaattacaacaaaaatgttagtttgtgaagttgggatcagattaagttgacttgaaatgtttcttctcctttggataatgcatggctgaacactgaatactgtaacccctttttattgcttctatacacgatagtatccctcctacccctgtttttagctctaagggagaaactattaatcctacgtccttagtttgcagtataggggaggattactttactattgactcgtagtacacatttgtatgttttctcttagttcagtgaggtagaaagggcagacataatgaaaatacggacttcaacctctgaggataaagagctatactgtatgaatttgaaagataaggctgttaatatgtttgttttttattgaatcacatatggtcagttcccattattggggtgtatgctctagttattcttgtgtgtgtcctatcctttcataaaacagtaagagaagatttaaaaatagatatttttcttattaagtgacaaaatggcttttgacctctagtgctcctttgaacttacagaataggagtgcctaaatgggcatccacatcataatcagaaaataggtaaatatatacacctatgtatatatccacaaaaaatttaaatgaataaaaacaattttaaaaagtaggttgacgagcctgtaatcagaaaaaggcaggtacatgaatagtgtattttatagctaaaagagcctggtatacctaactccatatgctctcctaagtgggaagtatatgtagaaaggtacattgtatatcctataagatcaccattttactgtctcaaacttcaacaatttaaaatcaacaaaatgtaatatgaaatacaggctgattaatgaagatccagccactgcttatggtctcgttttcccaataaaatctcatatctgtaaagcctttctatatatagactcttccaattgaaagagcatcttatcgcttaaacaggtttcctgtttatttgcgtagaggtgtttgtagtattctctgatggtagtttgtatttctgtgggatcagtggtgatatcccctttatcattttttattgtgtctatttgattcttctctatttttctttattagtctatctagcagtctattttgttaatctcttcaaaaaaaaacacctcctggatttgttgatgtttttttttttttttttttttttttttaaatgtttccgtctccttcagttctgctctgatcttagttatttcttgtcttctgctagcttttgatttgcttgctctggcttctctagttctttcagttgtgatgttagggtgttgattttagatctttcccgctttctcctgtgggcatttagtgctgtaaatttccctctcaacactgctttagctgtgtcccagagattctggcacattgtatctttgttctcattggtttcaaagaacttctttatttctgtcagaattctgttatttacccagtagttattcagaagcagattgttagtttccatgtagttgtatggttttgagtgagtttcttaatcctgagttctaatttgtttgcactgtggtctgagaggttggttgttatgattttcattcttttgcatttgctgaggagtgttttacttctaattatgtgatcaattttagaataagtatgatgtggtgctgagaagaatgtatattctgttgatttggggtggagagttctgtagatgtctgtgaggtccacttggtccagagctgagttcaagtactgaacatccttgttaattttctgtctcgttgatctaatgttggcagtggggtgttaaagtctcccactattattgtttgggagtctgtctctatgtaggtctctaagaacttgctttatgaatctgggtgctcctgtattgggtgcatatatatttaggatagttaggacttcttattgcattgatccctttaccattatgtaatgcccttctttgtctttttttgttttttttaaatctttgttagtttaaagtctattttatcagagaatagaattgcaacccctgcttttattttttttgctttccatttgcttggtaaatattcctctatccttttattttgagcctatgtgtgtctttgcacgtgagattgctctcctgactacagcacaccatttggtcttgactcttcatccaatttgccagtctgtgtcttttaattggggcatttagcccatttacatttaaggttaatattgttatgtgtaaatttgatcctgtcattatgatgctagctggttattttgcttgttagttgatgcagtttcttcatggtgtcgatggtgtttacaatttggtatgcttctgcagtggctggtactggtttgtccttgccatatttagtgcttcctgaaggagctcttgtaagacaggcctggtggtgacaaaatctctcagcatttgctcgtctttaaagcattctatttctccttcgcttatgaagcttagtttgactggctatgaaattctgagttaaaaattattttaagaatgttgaatattggcccctactctcttctggcttgtagggtttctgcagaaagatctgctgttagtctgatgggcttccctttgtgggtaagccgacctttctctttgactgtcctgaacattttttccttcatttcaaccttggtgaatctgacaattatgtgtcttggggttgctctttttgaggagtatttttgtggatgttctctgtatttcctaaatttgaatggtgggctgtcttgctagtttgggaaagttcgccgggataatatcctgaagaatgttttcccaggtatactaatcaaacttaggttttgtcttttcacatagtcccatatttcgtggaggctttgttcattccttttcattcttttttctctaatcttgtcttcacactttatttcattaagttgatcttcaatctctgatatcttttcttctgctggatcgattgagctattgatacttgtgtatgcttcatgaagttgttgtgctgtgtttttcagttccatcaggtcatttattgttttgcctaaactggttattgtagttagcaactcctctaaccttttttcaaggttcttagcttccttccattgggttagaacatgctcctttagcttggaggagtttattacccaccttctgaagcctacttatgtcaattcgtcatactcattctccatccagttttgttctcttgtttggtgaggagttgtgatcctttggaggagaagaggtgttctgggttttggaattttcaccctttttgtgctggtttttcctcatctttgtggatttatctacctttgatctttgacattggtgaccttcagatggggtttctgagtggatgtcctttttgttgatgctattcctttctgttttagttttccttcaaacaggcccctctgctgcaggtttgctggagtttactggaggtccactctagaccctatttgcctgggtatcaccagcagagactgcagaacagcaaagattgctgcctgttccatcctctggaagcttcgtcccagaggggcacccaccagttgccagccagagctctcctgtatgatgtgtctgtcgacccctgctgggaggcatctcctaggcaggaggcacgggggtcagggccccacttgagaaggcaatctgtcccttagcagagctccagtgctgtgctgggagatctgctgctctcttcagagccggcaggcaagaacgtttagtctgctgatgctgcacccacagctgccccttccctcacgtgctctgtctcagggagatgggagttttatctgtaagccgctgactggggctgctgcctttctttcagagatgccctgcccagagaggaagaatctagagaggcagtctggctacagtggctttgctgagctacagtgggctctgcccagtttgaacttcccagcgactttgtttacactgtgagggaaaaccgcctactcaagcctcagtaatggcggacgcccctccctccaccaagctggagcctcaggtccacttcagactgctgtgctggcagcgagaattacaagccagtggatctcagcttgctgggctccgtgggcgttggatctgctgaacttgaccacttggctccctggtttcagccccctttccaggggagtgaacggttctgtctcgctggcgttccaggcaccactgggtattagactcccacacaataatagtgggagacttgaacacaccccactgtcaatattagacagatcaacgagacagaaaattaaaaaggatattcagtacttgagctcagctctggaccaagcagacctaatagacatctacagaactctccaccccaaatcaacagaatatacattcttctcagcaccacattgcacttattctaaaattgacgacataattggaagtaaaatactcctcagcaaatgcaaaagaatgaaaatcataacagcctctcagatcacagtgcaatctaattagaatgcgggattaagaaactcaaaagtgcacaactacatggaagctgaacaaacctgctcctgggtgactactgggtaaataatgaaattaaggcagaaataaataagttctttgaaaccaatgagaacaaacacacaatgtagcagaatctgtgggacacagctaaagaagtgtttagaagagggaaatttatagcactaaatgcccacaggagaaagtgggaaagatctataatcgacatcctaacatcacaattaaatgaactagagcagcaagagcaaacaaattcaaaagctatcagaagacaaataactaagagcagaactgaaggagatagagacacgaaaaacccttaaaaaaaaaaaactcaattcaggagctgtttttttgaaaagattaacaaaatagatggctagccagactaaaaaagaagaaaagagagaagaatcaaatagacacagtaaaaaatgataaaggggatatcaccactgatcccacagaaatacaaactaccatcagagaatactataaacatctccacgcaaataaactagaaaatctagaagaaatggaaaaattcctgtacatatacactcttccaagattaaaccaggaagaagtcaaatccctgaatagaacaataacaagttctgaaattgaggcagtaattaatagcctacaaaccaaaaaaagcccaggaccagacagattcacagccgaattctaccagaggtacaaagaggagctagtaccattccttctgaaactattccaaacaatagaaaaataaggactcctccctaactcattttatgaggccaacatcatcctgataccaaaacctggcagagacacaataaaaaaaatttcaggtcaatatccctgatgaacatcaatgtgaaaggctcaataaaatactggcaaaccgaatccagcagcacatcaaaaaggttatccaccatgatcaagttggcttcatccctgggatgcaagattagtttaacatacagaaaccaacaaacgtaatccatcacataaacagaaccaatgacaaaaaccacatgattatctcaatagatgcagaaaaggcctttgataaaattcactacccttcatgctaaaaattttcaataaactaggtattgatggaatgtgtctcaaaataagagctatttatgacatacccacagccaatatcatactgaatgggcaaaagctggaagcactccctttaaaaactggcacaagacaaaaattccctctctcatcactcctattcaacatagtattggaagttctggccagcacaatcaggcaggagaaagaaagggtattcaaattctctgtttgcagatgacatgattgtatatttagaaaaccccatcatctcagccgaaaatctccttaagctgataggcagtgtcaacaaagtctcaggatacaaaatcgatgtggaaaaataacaagcattcctatacaccgataataaacagccaaatcatgagtgaactcccatttacaattgctacaaggagaatagaattcctagcaatccaacttataagggatgtgaaggacctcttcaaggagaactacaaaccactgctcaaggaagtaagagaggacgcaaacaaatgaaaaaacattccatgcttatggataggaagaatcaatatcatgaaaatggccatactgcccgaagtaatttatagattcaatgttacctcattaagctacaattcactttcttcacagaattagaaaaaaactactttaaatttcatgtggaactaaaaaagagcctgcattgccaaaaccatcctaagcaaaaataacaaagctggaggcatcatgctaccttacttgaaactacactacaaggctacagtaaccaaaacagcatgatactggtaccagaacagatacatagacgaatggaacagaacagaggcctcagaaataacaccacacatctacaaccatctgatctttgacaaacctgccaaaaacaagcaatggggaaagcattccctatttaataaatgatgatgggaaaactggctagccatatgcagaagactgaaactggaccccttccttaccccttatacaaaaattaactcaagatggattaaagacttaaatgtaatacctaaaaccataaaaaccctagaagaaaacctaggcaatacctttcaggacataggcatgggcaaagacttcatgactgaaacaccaaaagcaatggcaagaaaagccaaaattgacaaatgagatcttactaaatagctcctgcacagcaaaagaaaactatcatcagagtgaacaggcagcctataggatgggagaaaatttttgcaatctatctatctgacaaagggctaatatccagaatctacaagaaacaaatttacaggaaaataaccccatcaaaaagtaggcaaagggtatgaacagacccttctcaaagaagacatttatgtggccaacaagtatgtgaaaaaaaagttcatcatcactggtcattagagaaatgaaaatcaaaaccacaatgagataccatctcatgctagttagaatggtgatcatcaaaaagtcaggaaacaacagatgctggagagaatatggagaaataggaatgattttacactgttgggagtgtaaattagttcaaacattgtggaagacagtgtggtgattgctcaaggatctagagccagaaataccatttgaccaagcaatcccatcactgggtatatacccaaaggattataaattattctgtgcttatttcagcactattcacaatagcaaagacttgaaaccaacccaaatgcccatcaatgatagactggataaagaaaatttggcacatatacaccatggaatactatgcagcaacaaaaaaggatgagtttcatgtcctttgcagggatgtggatgaagctggaaaacatcattctcagcaaactaacataggaacagaaaatcaaactcggcatgttctcactcataaatcggagttgaacaaccagaagacatggatgcagtggagcatcacacactggggccttttggggtgtgtggggctaggggagtgatagcattaggggaaatacctaacatagatgacggattggtacagcaaaccaccatggcatgtgtatacctatgtaacaaacctgcacgttctgcacatgtatcccaaaacttaaagtataataataaaaagtttcttaaagtttacttatggctgcaaataagatgaggattcagcataagtcatatatttttaaaatatgtcaattcttgccattgtgttagggaaaccaccaagtacacatttatacatttttgctcagcatttttcaggagataatctcaatgatgattcaaagaaaaaaataataactcataagaatttttatttactgactgcttagtcacaaaagacagaacaccatctcttgaagtctcagacttagaacactctcttcgatagatttaccagcaaaattcgtgattcatgcctgtatagtaattgcttttgtgatgttcatatttttatttaaccagatattggttctgtagcttatgcatgatgttggctactctccaaagaaatttcattttaaattagttatgccccttaggagaataatgaaacatttggggagaattttattattgggggattgaagctatatttggtttaagaaatacctgccaaataatgctttgacaattttaaacataagctttgttgatagaattgctttataaaattaggaagtcattgaaaccttgtaggatttcatatatagaatttgatatgctttggccttaactggtgttttgaggcctgaggtttagttttaagtggaattgccttttaaaatgagtagcagtaggcattagcataagcgatttcaggagctgtttctagtgtgtttagatgctaacatatgcaaaaataagtacatctagggtaaacttaataaattatgtatgtttatgctcatagataataggtatatctctttaaaaatatccttttgtgaatcagacaattctcttcccgttatgatttctctgtaagacagtacattctacatgcgttggtcgtgggtttcatatacattgtttctctgagtttcaaacagattggtttgtttgccagtccaaaaaaaaaaaaaaaatcctccctatattaagagagtgctttgtcagctttcccctgtgaataacaaagtgaggatgttctctttaaaggaataaaacaaaaaatcagggataaaagattgcgcctgttctagatgtcttttgaatattagtgtagaaagccatttccatttaggatatgaaatatgatatggaaatgttcttacttatttaccagggtaactttagaacaaaaatgaataatgacagtcaaatttgaccaaaaaaggaaggacactaggactcgagagaaatttttgtatcctcaaaatgacatttacaaacccgttagggtttggttttaatcccctttattttgacttcctgagaatggtgacacggattctattttctgcttggctaatccctgcatcactcttgagttgtttttatagccttcttttccaagaattagctctgcctgttggaaagttttactcctggagtgaatgctttcagacttggctttgtatgcatgcaggattttaacctacaaaaataatcatggaaagatacatagaatttgctataaaagagaagaatatttttaaggcctcttatgttgggtttgatatcaattggctgaacaagggctgttttaacttttttccgcctctgctgtaatcatcacattttgataccataatggcaagaaatgtttataagtttacacaggttaaaattgagagggttaattctcaggaggattagagttaatttaaataaataaatatttttgtgaacataaacactaattttatatcatttagattgatttttgtctagaactcattatagagtaccttgttttcagaaaatctaatgcgattgcaatattataggtgttccttctctatatacggtatttcaactagaaatccttactgtaaatatttcagacaatttagagtcaaactctgcagttgaaaatatatttaagaaaatatttaagaaaatatttcactggcacttacatgaatgaaaaatggccattgcctttttgatgacaaagtaatatataccaaataggtatgatacagatgattatattaacattcagatattattgtagcaatttcctcttccctgatgggaaatcttgaaattgctcttcatgacaaaaattaagacgtaaatgttatttcccagtggcctaaaagttagaagaggcatgagagtattccagtgtgttctcttgatgttatgtgttgtacatctttctcagttcagataccataaaaaaactgagtattttctgggcagttggaaccagtcactaataaatgaaagcaatttttgttctccttatccatttcagttgtttggatgacaaataattgcatgtaactgtcccaaattcacctacttagacaacagagacttgaaaaacattaaatatgatatttgtgtgtgcgggagcctggcttgaatttaccctttataacaaattttggtattttctactaatctttcacattcttctatgatttgtcaccattttaactttatggaaaatggtcaatttataatttctatctcccctaggggctgatttgttaaagtatgctttagttaagtaagagtttcttactcagttggggaatttaaataatgaagtataatcatgcgattgaagatgtgcattatggattaggttctatgccaaatttgttcagaaacatttaaatataattcttacctagataactgagaatctcttttcaattagcttaccaggattattttcacaactttttttttttaattacaggtgaaataacaatatccttggcctatacagtgacattaagtgatttttgaatgattgacaagacattaataaattaataatgagaaatgcagccatgaggttctaatgctaaataatatgtaatagacactttgtggatggttttcctagtcatatcatcacaatgagttcatgagactaaagaaatatattaaaaacatctattggtatttgttaattttatttcagctatgaaggaatacatgagatattaggtttgattcagaaaagtgttctatagttgatatctgtgtttcttgtcacagaattttgccttggcaaaaacattttgaccattctaatgatggtaaatgagaataaaatggcataagtagtttaaaattttctatgtggttttaagtcagtgataatatttgaatgtaatgtatattttgctgatagttggaaaacttacttcactgtcttcaaaatggagttaactgtgttttatacataattataagtgatatcacagggctgggtgtgatggctgacacctgtaatcccagcacattgggaggccaaggcaggagaattgctttaggccaggagttcaaggctgcggtgagctatgattgtgccactactctcaagcctaggcaaaagaactgaggccctgtccccccatcccacaaaaacaaacaaaaaaagacatcacagaacctgcaaatgaatatccaaaaaccttaaagctgggcactggaaaaatagatattaggttggtacatatgttttccaattaaataatttctatatataaaatgcatgtgacattttacagctggaacatgaaatataagatgaaaatatactattttacaacaatatttgggtaaaataatgatgaactaaagtctttgttgatgtcatttaaatcttataagagggaaatttaattgtcatacaataggatttattccttgcagagggaaacctgaagatttatagttgtcttgtcattttattttaaagcaataagctatcctcttagatttattctctttttagaacttttatttttattgatgcataacgttttacatatatgtacatacatgtgatattttgttaaacgcactgaatgtgtaatggtcaagtcagtgtatttggggtattcattactttgagtatttatcatttttatgttctgtgaacattttgagttctctcatctactttgaaatgtacatcatattgttgctaactctagtcacccctttctgctgttgaacattagaatatataccttccaactatatatttgtacccattaaataacccctttttatattcccttcctacccttcctagcctctggtatcttattatactctctatttccatgagaacaactttttttacacctatatatgagtaagaaaatgtaaaatctatttatctttgcctcgattgtctcacttaataacctgcagtttcattcatgttggtgcagaaaatgtaattcttttttatggatgaagagtattccactgtatatatgtaccacattttctttatccatttgttcactaatggacacttaagttgctattataaatagtgcctcaataagcatgcaagtacaggtatgccatgcatatacttttcctgatagttagaaaagtatatgattgctttccctttacatatatacttattagtggcattgctgacacatactctatttctatgtttagttttttgagaaatcttctccatactgttttcaatagtggctatactgacttatattctgaactacaacaatgtattaagagttcccttttcgttgcacctcgtcaacatctgttgttttcttgtctttttaataatagccattctaactggggcaagatgatggctcatcatgacttgatttgcatttccctaatgattagtgatgttgagcattttttcatatacccgttggtcatttgtcttcttttgagaaatacttattattgtcctttgtccatttttaatgtgattatttttttactgttaaattgtttgggatcctcgtatttcctagatattagtctcttgtctgaatagtttacaaatcttttctcccattcagcaggttgtctcttcactctgttgaatccttcctttgttttacagaagctctttcattttctacagtcccaattatctatttatgtttttgttgcctgcgcttttgaggtcataaccataaaatctttgcctagaccaaggtcctgtctgttttccctatgtttgcttcatgtagtttcagttttaggtcttacctttaaatccttaatccatcttgagctgaattttctaatatggtgagagacagggatccagtttcatacttctgcatctgacaatccaattctcagcaccatttgaagaaggtgtccttccccctaatgcatgttcttggtgcttttgtcaaaaacaagttgtatgtaaatacatggatttaattctgagttctctaatctattccattgttctatatgtctgtttttattctaacaccttgctgttttgtcaagtagtgtgattcataagtctttgttctttttgctcaggattgctttggctattcaggctctctgctggtctttgatcgtacaaattttatgatcactttttattccatttctgtattctgatagggactgcattattcaatgtagaatgctttgagtagaaagatcatgttaataacattaattcttctgaccgataaacatgggatgactttccatttgttggtgtactcttcaatttgttttgtcagtgttctgtattttatacggacctttccctcctgggctaaacttactcctaggtattatttccagccgttgtaaataggtttgccttcttgatttctttctcagccagttcattattggtatatagaaatgctactgaattgtgtatgttgatttttgtatcctgcaactttactaaatttatttatcagatctgagagctttctggtgagggtttagctttttctagctataagttattaacaaagagcagtacttggacaacgatttcttctattaggacgccttgtatttctttctcttgattgctctggctaggacctccagtactatgttgaatgagtggtgaaagtgggcatccttgtcttgttcttttttttgtttttggttttttgtttttgagatggagtcttgctctgttgcccaggctggagtacagtggcccaatcttggctcattgcaagctcagcctccagggttcatgccgttctcttgcctcagcctcccgagcagctgggaccacaggcatctgccaccatgcccggctaattttttgtatttttagtagagatggggtttcaccgtgttagccaggatgatctcgatctcctgatctattgatccacccacctctgcctcccaaagtgctgggattacaggcgtgagccaccacgcctgaccattccagttttatagggagaaatttttcagcttttccccattcagtttgatactacttgtagatttgtcatatatggtctttattttgttaattttttttgtatgcctagtttgttggagtttttatctcgaagggatgttaaattttatgaaatgttcttttgtgtctattgaaaggatcatgttttctgtttttcattctgtttgatgtaatatgtcatatttattgatttgtgtatgatgtatccttgtatcattgggataaattccacttgataatattacattttttatgttctattggattgctagcattttgtagagaatttctacatcagtgttcatcagggatgttgtcctgtattttttgttgcataattgtctgggtttggcatcagggtaatgctggcttcatagaatgagatagggggaattccttcctcttcaatttttcttggaacacttacaggagaattggtaaagtttggtagaattcagcagtaaagacatctggtcctggactgtcttcgttgggaaattttttaagattactgattcaagatcattactaattatagatctgttcagattttctatttcttcttgatccacggttggttgtatgtgtccgggaatttatacattcctctagatttttagtttattatttaatagttgttcagtatagtctctgaactttttatttctatggtatcagttgtaatgtctccgtcttcatttatgattttgagtcttttttttttcttggttagtctagcaagtgctttattttcatctttttaaaaatcaaacttctcatttcattgatactttgtattttttgctctctattttcttgagttttgctcaatttttaggattttcatccttctactaattctgggtttggtttgtttttttttctttgactagctccttgaagtactttgttagattgtttgaaatatttcaacatttttgatgtgagcatttttgctatatacatcccccttagcactgcttttgccatatcccgtaggtgttattatattttgatattcatttgtttcaataattttttgaaaacatttcctcaattttcttccttgacccaatggtcattcaggagtatgttgttcaatttccatgtttttgtacaggttccaaagtttctctttttgttatttccttgtgttttaagaagatattagatatgattttgattttttataaatttgttaagacatattctgtcataacatatggtctgtcctggagaatgttctgtgtgcttatgagaaaaaaatgtgtatgactgttgaaggaattgtcctataagtgtctgttaggactatttggtctaaggagcagtttcaagccaatgtttctttgttaattttttgtctaagtgatctaatgctgagagtggggtgttgaagtcctcagatattactgtatttgcatctagctctccctttagatctaatacttgctttatatatctgggagctctcgtgttgggtgtatgtatgtttagaatttttatatactcttgctaaacttatccctttatcattatataatgaccttattgtttgtttttactgtttttgactgaaagtctgttttatgtaagcatagctgctgcttctcccctttggcttcggtttgcataaaatatacttttccatccctttacttcaaatctatatgtgtctttacaggtgaaatgagtttattttaggcagaatatttttgggttatatattttttaatccattcagccagtttatgtcttttatgtggaatgtttaatcaatttacattcaacattattactgatatgtgagggcttatttctttcattttattgatttatggttgttttgaatattttttcttcatttttttccctcattatcattatagtgtgatggtattctttagtggtaacatttgagtaacttttcttgattttttttgtgtgtttgcactactagttgtttttatatttttatgtgttttcatgatggtagttgtcattctttcacttccaggtataggactcccttaaacctttcttgtaaggccagtatcatggtgataaatttccacagctttcactcgtctaggaactattttatttctccttgatttatgaaggctaccttggctgggtagagtatccttggctggtggttgttttctttcagcaagtttaatataacatctcattcttctctggcctgtaaggtttcttctgagaaattcactgttaatctgatggaggtttctttataagtgacaaggtgcttttctcttgctgtttttagaattctctttttgtctttggcttttgagagtttggctataatgtgtcatggacaagacatttttgaattgtatccctttttgagatctttcagcatcctgtatctggatgtctaaatctcttgctagacttgggaagatttcatctattattttgttaaatagggtttctaaacctttagtttctcctttaccttctaggacataaaaaatgcaagcatttcatggctttatggtgttgtatatgtcacataggctttgctcatttttttaaaattttttgttattttttgtttgagtaggttattttaaaagacctgttttcatgttctgagattcttctgttttatctagtctcctcttgagtctttgcctttgattctgaatgtatatagtagtatacttcctgtatgatttctttggatgtaaacagtatgaatggtgtctgtaacttcctcagtagcttagggtgcagttgttagcagaagctgtggtgaagttttgccggtgactgggacaccaagtggtccagtcttcaggccccagtggtggcatcagttggttgagcgtgcctgtcctcaggcctcagagctgtgtacattggcattgatgttagtgtgtccaggcaggctaaccctttggcttataggtggcttgcttggttgtcaggaaaagcataggtgggctgggtgggtacacaggttcccagcccaggggcagcaagcatggtgcgggtaatggcaatagtgggaggggggcaaccctctggaatgcaagcaatccatgatggtgttggtggtggatgcaacagattgggcaagccagttcctaggcctgcagatggtgcatgtaggttgacgccagctttggtggtagtggaagcttgagtgggcccaaattcaggccccaggaagactagtcagatgccaatggtggtaaactggggtgggagagccccaggtctctatacaaatttttatgtactgggggatttggaagagcagagctgggaagacctgtcctcaggactcctggtggtgcatgcaaccactggttattgtagtcgaggggcaaggtgctccccaggtcccttgtgcaatgctcaggtggaaggcagtgttggctacactgtggccctgctactggagagggtaaggttgctttccttgggagcagccataagcagttgcctgggtagcctgtgcgtcgcttgtgtctcaactccacagcagttcacagtgacagcatttgcaggcagtggaattagtcttcagtgtgcatgaagttgagtggccacccctctgttgggcaggggagggtttgctgccagtggttcctgccttggccccagcagttgcagccatgggtgggaaatatcactgagactccaggaatgtggagatagggaagatttttagtcctaggtcaggacatagactggtgggggctgggctctcaaaaccaggccatgttgcagctgcttaggactctagagtttgtggaacccagcatgggcttcttccgtgaagcaatgcctttgcacagtatctagacagctgtgtgttggtttgggggcccacacgggttgaagggctctcaattggctaggattgtaggaatcttgtacaagaatgtgtacctttgtgcatctctaattctctccccatgttagggagcctctccagactcctagccaatctcagctggatagagtgcctcatttccttctttttccttttagtggttttcattgcttctctgttgaatttcagtgttttctcttagttaatgtattcaaagtatgattatctacttggtactttggttcctctccatggaagaggtgagtaacagatccatcaattcagccattttgaagccccagattttttgtcttatggcaatcgtgtggagttagtggatcatatgatatccagttgaaaagtgagaaaactgttacaactattaaattattaggaattttatatattattacaatttaataaggtggttgaaaccagtgtttttacttttaggaaatatcctgtaatatcattcttgtgagatgttaatattgctgaataaacttttgcttcaaatcaaagcacatttttcccctgcaaagatttttctaatttatcatcagtgatataaactcaaatttgcaagttccttttggtagaagagtgcaaatgtttaagtagggcagtcatgttctagataatttccatactttatcttatgtcttgtacacaacaattccaggtaagtttatccttcttttataaatggaaaaactgaggcttagagagctttattaaaatcaagatcacacagccaatagataactgagctataatcaaatccagggtttatctcttcttaaagtccgtgttatttctcacaagactgtccaataaaatcggttggggaagctttatggcaacactgggattgaaactagtattttatttcactgaggacgggctgtgacatcagcaatttttagaagctcagtaagtgagagtatcctgcagctaagatagaaacaactacaatggaacaattgtttctgtgagatatgcccttttataggataagatccagaatctgttgtcccagcatttgtttagacttctagcattttcttccttaaaaaatgactaagcctgctgttcacatcttcaattactggagtactgcttattgctaacagttctgttaatgagaaattgttcatccacagacaaagtaaaaatagactagctgtcacataagactggccatcaaaacattctctttaggattaagaaacttgccttatctcctgtctgcacagttgtctctcttcattccttcttctatttattgcttcacggacatgtttgtgatagaatggtactctgactcaaacagtttccagcaagggttgcccaggtgagaggagctgtttgcagaggtgatccctgactctttgttctttaatttatttcttcttttgcctgcctctctcatcttgttactaattgacatcactgtgttctgctatctgaggtttgttgatgccttttgcagccaataaaaatgtctttcattggcagagctgataaagaactagaagaatttttaataataactaagggctaataagggaaaacaattaaaatgatggtaaaataatagttttcaaattagaagtctgatcccataaatccacttgaaataagcaaatggcttaattttatgatctctgatattaatgccataaataggttgaatttatttaccatttatccagggttagttttgctaaacagtttgtattttagccagatatgcaacttttactgacaggacataatgaactttggagcctgcactgttagtgtagttgtaaggagataaaattggcaattatactcacagatggaatagaatttaatctatgacatttacttagctgtacagaaggatacaaggcaggagatacactgtcatagaatctttgtatcattggatggcccagaagcaaccaacatacagatttccacatgcctctcacccaaatgtgctccatatagctgctaggacaacggccaaaatcagtgtggtttacttgacatgaagaaattgcagcattaatttcccaccaatatttaataccattgttgtcacataggacaaaagactatatattgcctctctgccccactccccagttaatttaatagtagtcctacctagcaaacaagagtgacaagaaattctactattatcttaactcttaatcctaagaaaataagtttctatgttcattttcctaggcagcatcagattaacctagggttgatttaactttttctacacagagccaactagttttgggttaaaatctgatttttgcctttattagttttaggccactggaaaattattgaggctcagtattgctcacgtgtaaagtaaaaatatttacctcccactgctacttcaaggagtaagtaaaacctgtatgtatttggcccgtaatatgagcccagaaacagtagctaaagttatgtcaaataactggaatgttgtaaaaattaaatggtccctttatactcctgtagggaaaactgatctttccagttattttgcctgcctctagaataaatgctgactctccccaaattaaatacaggagtcctcccttattcattacagtttctgctacccatggtcaaccgtggtccttaaattgatgagtacagtacaattagatgatggtggggagggtgggcagggagaggtgagagtccacattcacgtaacttttattactgcatattgctataattgttctattagttattaatctttttctgtgcctaatttataagttaaattttatcataggtatgtatatgtatgggaaaaacagtatatatagggcctatttgtggtttcagacatctgctgtaggtcttggaacatatcccccgtggaaaagggggatctactgtcatttcccatttgaaatcttgctggtcttcctgtgaccttcccactcattctggttttctggtctgaggaatactgctggctcacagctggtgtactgggtggtaatctttgatatccttgagctccagagtctaatctagttttcataaaagatttatactatatcttaaattcctcagagtggttctctctctctttctctctctctctctctctctctctcacacacacacacacacacacacacacacacacacttgacagagagattgattcacagttgtcatggatacatggtagatttctagcaagtctcctgaaggctggttcatgatagtaccttataattgtcatagtatttgtaagacattagttagcacacttgcaaaagtataactaggttttctcttgtagtcattacgtcatatgacatcgtaaaagtggttgaattggttcccagactctcagaaaaactcaacttctgaagctgggagtaatacatacatagtaatattgatgtaatctggtgtgatatttattaaacattaagtgctgggcacattgcttgatattgtataatttcgttttatttctgcaaaaactctaggaggtagagactattattttggtcatttgcaactgaagagtttatgtaaattgcccacatcactcagctagtgagttggagttaagattccctacttgtaactactacagaatataatcttatggcagaatattcctctcttcttccatgaatattttctttgcattaactaaaaggttactcattttattacagggctaattgggtttgtttttaattggatgcacatccatcagttgattccaaatgttttgaaaataaatggaaaagttttataaactagagccagaataagagggatactgaattctttttactatgatgtttccttgagagaatcattaaataattaaagtagaaggatgtttacaaatcttgcaagtatgacattctatccaagccacactaaagttatcaaagggagacactcaccagttatgaaaatattcccctctactctttctcagttaactctaaaattagatggcaaaggcatcaaaacatctcactatctcaaatatttcctcagtgaggtcgtgatgtgaacatctcttatctagattgaaatcccaccttgagtcatatgtggattaaaaaaaaaagctattatctgagaaagtctaaataaaaagatacattttacctaggctttaatatctaagtttttctgtatagaatcagttgggcaagtgagtctcttggaaaagtgatttgaaaactgtttttattaataattggaatacacacacacacacacacacacacacacacacacactcttattcctcctcaagaggcaagagtacatggtgaagcccttaataaattcacctcactgtagttaaacagcagactatgatattgttgtagttgttaatcaaagggactctgaaaagagacagccagaagtggggaaaaaactagtatagaaaaataacgattgggcatttgagtatttggaaaaaacctggtgaagtaactaggttttaaaagactgaagagaaagacaaatttcacccattgcaaaatataacaacgatataaaaatgagacataagctcctggataaaaataaataatgtatttttttctctctattatatctcgaattttgctttcaccaacaaactgcatgtgaaatacgaaaaaagttaaaaaatatggaatattaagggactataagatgagaaatttttaaattgttataacctaagtaaaactgctaaagctagttgtagcgagatctgtcttacataaattttccattaaatgataatatctttgcattcatcataaacagaaatgtacattttaagcaaaatcattataatagaaatgataatactccttacctagccttcttcacgttaatcttaacatagactagtgaagaacatagcaaaggtagtgcttgaaggaatgttcttattgaaagaaatctttcctcagattgatcaagaggcattgaataatcataataattcaaactttaatcttgcagatggaatgaaaatgtttaaaattagaattattgtcagagcttaaatattgttacttacacaagccaaatacattaatattatgagcactattgttttagctaatgtgtcttttactctgcagagtacatatagactagtctaaaaggttttttttttttaatgcttttatagagcacgagcatttgtgcaggtggctgagtagactaagattttttccaatgggttgatttgaccacatcattaataaagtagaaattctggagcccctactttttattcttagtctgacattgtaaattctttcagatgctacataagcattttaaagttatgtgccccaggcttactttgttcagtagaaatgcatgttaattcatcaaatgtctattgataactttacataaggaatagtgctatatactccaagtgtgtcaggaagtaaaagatatacagtctgccaaggtattgaaaattgcatataggccaacaaacaatatataggtaactgttatataagacagaatgtgaactaattcagagaatattttttaaagtacagagcatgtttttcattctaataaatgtacaaatatttatgtcaaatgaaaatgtggctgcatcataattcttatatgggattttaaatataccaaaatccacggatccatacagtagttcttactctgcttccctaattttattagttggacataaatgcataaatcgataagatgattttggagcgggaacctaactttttctatagttccttggaagttaattgatttcttaagtgataaagtccaccactattttgagtaaggtttagttaatgatttctgtttaacatgtgtgatttctaataaaaagttctggatttattttctcttgttgaaagttgttcattagaactgacacctgagctaacataagcaaaagtcattgtaagtccacacgtttgcacagatgggtgtccccccaccatccttaggtttgagcaatggatttttacaagtgaaactcagtgcaattaatcacctccaacatgagaaaatgctctttaaactattttaagtcaacatttacaagagaaattggcctataatacacctcgggttcttaacctttttgagagctatagaaacgctgcttctctataaaggtaacatatattgccaataaaatacataagggaggacatctacttataaaactcagaaaacgatttaataggaacagttgttttattagccttctgctctttaatggctgagatcatcctggggctatttaaaaatgatttaatttgtcctctaaacacacagatgagttccaggtgtgtatttcccccccccacccccgctccatgaatcaaccatgtctgcactgacattaatagcttggatcgggaaatctctgtaataataaatctatcttttaagttggtcatttaagcagctttaagtatgaaaaaagtgaagtattagaactatttcaatccatgatgccttatagattatactttaagaatacgactgtgcctcactatctgagaactggttctaggaactccagatactaaaatctgtggatgcttaagttccttatataaatgatgtcatatttgcatataacctatgcacatcctcctgtttacattaaattatctctagattacttataatacctaatacaatataaatagtacgtaaatagttgttacattttattctttgtgtttaatttctaggttcagggttacacatgcatttttgttatatagataaattatgtgttacaggggctctgagtacagattactttgtcacccaggtaataagcatagtacccaacagggagatttctatcctgttaatttttattgtatttcctgaatatttttttatttgggaaacaatttattttttttggaaatttttgtgggtacatactaggggtgtgtgtgtatatatatggtatatatgtgtatatatatgtgtgtatatatataccatatatgtgtatatatatgtgtgtatatatataccatatatgtgtacatatatgtgtgtatatatggtgtatatataccatatatgtgtatatacgtatatacacatatgtgtatatacgtatacacgtatatacacatatgtgtatatgtatacatatatggtatatatgtgtgtatatgccatatatctatatatatggtatatatatatacatatatgtatatacatatggtgtgtgtgtatatatacaccatatatgtatatgtgtgtgtatatatacaccatatatgtatatgtgtgtgtatatatataaacacaccatatatgtatatatacgtgtgtgtgtatatatacacacaccatataggtatatatatgtgtgtgtgtatgtgtgtgtgtatataatttttgtgggtacatggggtgtttgtgtatatatgatatatatgtgtatatgtatatatatacgtgtgtgtgtatatatatatggtacgtgagatgttttgatagaggcatacaatatggaataagcacgtcatgagaatagcatgtcacctcaagcatttatcctttgagttataaactaattacactcttgaagttattttcaaatgcacaattattgactatattcaccctattgtatcaaatcagaggttatttgaatttgcagatacagaacccgcagatacggagggcccactgtatatcactaaatcattcatacctctccacctgtacaaccaccaccatagttcaagttattctcatctttttctgtgactgcaggaagaacttgacaatgactggccctattttctttctggatttaacttaattctcttttacacacaatcatctagcatgatatttacatagtttaaggccttagcacttgctgttccaactccctgggatgttgttcttccactctgcatttcacagctgaaccccagaaagattatgtcctttgttgatttaacccttctcagaatagcatgtgtctctgttactgcatacatattgaaactattcttagttttttgttttgttttgtgcttatgttatcacatactatacacaccaagtctgtaggctgtttttttgatattctagtgatttttaatgataatatttaatacatatatgagaaaagaacctttttaatgttaagggagagcatgatctgtgaaattatctgtctttaatttatctttggaaatgaacatttttcaaagttttcattagattgtattcaaaattggtttttattctaaaaaattaccatgttactatttcatatttaaatgcaactaggattagacaagcaacaataataatttttttcttacctgggagcctacatgaatactgagtgtattaagatatcaactgagatatcttgctatcttagtttgaggagaataccatatatttggggaaatagagagaaagtggagtgaacatgtaatttatgtctcttaaaggtgactcaaatgttctttatctgtatcttaaaatctttagtgagcattcttccttatgtttaggctagttttctctctgagataggtaaagtaagctactttgccttagtatgcggatgtatgtgtgtgcacgtactcatgtgcccatcttgtcaatacatggagagatggaataagacgaatgtagtatgtctggggtagaaatttggttgcaggagagaggctgacacattcacaagcagcagcaagggaagagggattactggagtagaggcaagggagaatttatttacttaattacataatacttatttagaatctacagtgttcccggtatattgagttatatatgagaatgcaagaaaatgacatcactagtttaaagatacaatgtcttctgtttttcaaatgtttcgttgattttgttttattcaatactgtttagtacaatattaacagagtaaacaacagtatgagtccttctcatgtttcactttgattgtatcattgatatttaatccaacgtaaaattcctaaccttcaaaaaataattctcacttaatgttccagtggagtttgttcccaccatagtactgctggcctatcacaatgctgtaggtagttgtagacttgttcagtcctgttattggtggtgacttcctcatgtgctgggacctttattattcacagctgaattcccagagcataagagtgccttttttttttttttttttctttttttgagacagaggctcgctccgtcgcccaggctggagtgcagtggcgcgatctcggctcactgcaagctccgcctcccgggttcacgctattctcctgcctcagcctcccgagtagctgggactacaggcgcctgccaccatgcccggctaatttttttattttttatttttttttattttttttttatttttagtagagacggggtttcactgtgttagccaggatggtctcgatctcctgacctcgtgatctgcccgcctcggcctctgaaagtgcgagtgcctgttttttaatgtacaacaaatgtttcttgaagacacggcttttacattagcatattacatgaaagtgtgagggtcattaatatgtgtgaagaccagttaggattttaaagttctgatcagatacgttatcaagctgatagattaaattaactgattaatccaaggaattaacattaacaagcaatgaaatggtcagtatccaagtattgaagttgtatttgggttttacctaatattttccttgatcttactggctactttgttgtctaagctgaagaaaggccttcctgattacctttatttaaataaaataacagtggtgaaggtaatttcaaaaaatattaactatgctaaaacatatacctgtggtttgatatacaagaagctgcagaaggttctcagaaatatgtaaaacaatttattcccaaggtaattgataattgtatgcattcttacagaataagctgttataaaatttcaaactttatctaaaactcaatagcacgtctcataaaatgaactaaatagttctgtcgggcataagaatgtcggcttctagtatagaattccatgtatggtacaaaagttgtagagagattgtgtaattgctacattcatcgtataattttagaaaaatcctcttggtaatttatatggtaaaaattgactgttacaattagaaacataaggcatattttgtctcaatggattttattgagtatgctaaagcaatacacactacatatcgggtaagtgtgtgtactatgaggggagaagtatatggatacacagatcatgatttctatgtaaaatttatatcaggcttgtatgggagaagatacatgacaagttaaaatataaaatgaccacataattaaagtataatttaaattgggattattataatttaaatattttcccaagaatatcttgaatagtaatctttaaaatttttctttttttgatttttttattatacttttagggtacatgtgcataacgtgcaggtttgttacatatgtatacatgtgccatgttggtgtgctgcacccattagctcgtcatttaacattaggtatatctcctaatgctatccctcccccatacccccaccccaccccaccccaccccaccacaggccgtatgcagccataaaaaaggatgagttcatgtcctttgtagggacatggatgaagctggaaaccatcattctcagcaaactatcgcaaggataaaaaaccaaacaccgcatgttctcactcataggtgggaattgaacaatgagaacacatggacacaggaagggggaacatctgtaaaatctaaaaataatttagtttcaaaagataactttaaaaatgtctaaatgctagtggtaaaaattaaatatgtagatgatttattaaacattttaaaaacctcatgaaaaagggaatgtgcgacaaaagactaatttgcagctatcaaaaaataggaacagaaaaaatgtgctagcatattaatataaatattaggtgtcattgtgtgtccgagcaacattgttatcagttcccatctagtaatgactctctgtgtgtgtgcagtaaaatcaataataaaggggatgaataggacgactttcatttgaaactaaatctcttggaattgtgtgagctactgtgccacctatcagtggaatgatgaaataattcatacatgaacaattagcttaaataatcagcttaatttagtcaaatttattacaggcaccagtttacaaaaataattggtgcccaagatatttaatacttgggaataccagaattagagtatatcggagacaaagtgaaatctggatactcaatatgatacgacttttttgtttaaacctgcatatttaaactctcctttggtagttggatgctggctccccaaggatactcatgtcgaaatccctagaacctgtgagtatagtacatgatacatgacacaggggaattaaggttgttaattagctgatcttaaaatagggagggagattaacctggattacctgagtgcacactatgtagtcaccggaatgcttaaaaatgaaagaggcacaagagtaggcctgagtgatataatttgagaaagactatacctactgttgttcgctttgaagaatggaggaagaccaggggttaaggaatattggaggtctataaaagctagaaaagggaaagaaacatgatctcttctagaatttccagaaaggaacaaagccctgctgttgcttgagtttagtctaataagactcatgtcagatgtctaacctactcagctgtaagataaaacatttgtcttgttttaagccattaagattttgggaatatgttacaacagtaattgaatactactgcactctctgtagttttttttctgttcagtttcttagctctggtctgttgtacttggctgttcagctttggggcctgacaaactgccctcaatggtagaagtccagcagtgctcatttctatagggttcgggacttgaatcacaaaaggcacgaagggaaaaactttttccctcaccctagacgaaagtccatattttttttttttttttttgcgaggatctgacattttaaaagatgtttagcagtagaaatccctactgttttcagggaatattatcctctacgcttcttacctggcacagtcatgggacaattacatcaacacacaatactttgtcctatatattctgtattatttttaattaacagcatcaactgacaaatctatgttgaaccatatgaagcccaggtctcacctacagtctcttttccagtaatattcagacatatatcagttttttagaattcttgctgggattgcttcttgtatggttaaatgaatgtgctcatgtgcatgggtatataattatgtgcatgcacacatggacgtgcgcacactgctggacatccaaaattgagcagcgatgtgcacagggcataagaatgtatacttgatacttaaaaggatttctaaaatttttacacagtaactgttgccatccttaagatagctctttccttaagtatgcaaaaacagttgggctgtttcaaatgcttatggaagcatctgaaatttccttgcagaagaatgtctttgttttaaatttacatgtctaaataccaattggaaaggtaaagatttgctcaatagaaaggagtaatctgttaaaagtttaaaaaataccgatttcttttggaaaactgcgaagtcctgaattcagaggtcttattcttgtttattctaatcaccccatctgaaggaagcataactttccccaatgactgaaataataacagtaagaatgagaatacatggaaaatgatattaaattcttaccataaacaatcttaaaatttttgctttgaggttaagttttctgagaaattccatacttgcttaaaatatgtttttacaaagtaataactgccattattatttacaacacattaagtactatcctagttatttcaattgcatcctcccattaatttcctagcttggtaggattccccccccaaccagaaaccaaacttaaaaactaggaacttccagtccagtctgtatccctagatgtaagattctgacctggataaattgataatgctgcgaaacaaagtgacctagaaatccagctaatcttatcagtgctcgtttttaattgagaaaatctaattactcagataattgtggagcgtgttgcatactcttaattactgtaaaaacaaaaaaaaaagacaaatttatgctgctatataggcctcacgccctataaaactggatatacttttttatgacccatttagcttcattcattttatcagtgcatagaatgcagtatgttttccttatttcatactattttgttttactttttgtaaccataaaacatcagctttcatgcacaagcatatttttggttggatgagtttgtttaattaattaagcatttgagaacatcagtggtttagttttgaggtgtcacaaatagaaaaacttagggaaaatttctcattgtattggaaacaatttattctgcattaataagttgatataatttggctctgtgtcccctacccaagtctcatctcaaattgtaatccccacgtgtagagggagggtcctggtgggaggtgattggatcagggaggcggttgtccccatgctcttcttgtgatagtgtgtgaatgctcatgtgatctgatggtttaaaagtatttgacagccttccccccgaccccactgccctgtgaagaaggtacttgcttccccttcaccttccaccatgattgtaagtttcctgggggcctccccacccatgtagaactgtgagtctattaatcctcttttacttataaattacccaaccacaggtactctttataacagtgtgaaaacagactaaaacagaaaattggtgcccagatagtggggcattgctataaatatagcaattatagaagtgactttggaactgggtaactggcagaggttggaacaatttggggggggggtcagaagaagacagaaagatgagggagagtttggaatttcccagagacttgttgaatggctttgaccacaatgttgatagtgatacggacaatgaagtccaggctgagatagtctcagatggagatgaggaacttgttgggaactggagtaaaagtgactcttgctatgctttagcaaagagattggtggcattttgccccttccctagacatctgtggaactttgaacttgagagatgatttagggtatctggcagaaatctgtaagcagcaaggcattcaagatgtgacttgactttttctgaaaacatacggttatatgcgttcacagagagattatctgaaatgggaacttttctttaaaaggaaagcagagcataaaagtttggaaaatttgcagcctgtccatgcggcagaaaagaaaaacccattttctagggagtaagtcaagcctgctgcagaaatttgcataagtaaagagaagcagaatgttagtagccaagacaatggggaaaacgtcttcagggtatgtcagagacctttgtgccagccccttccatcacaggcccagaggcctagaagggaaaaatggtttggtgggccaggcccaaggccccactgctctgtgcagccttgggacctggcttcctgtgtcctagctgcttcagctccagccttggctaaaaggggccaaggtacatcttgcaccattgcttcagagggtgcaagccccaagccttggcagcttccatgtggtgttctgcctacggctgtgcagaaggcaagaaatgaggtttgggaacctctgcctagatgtctagaggatgtatggaaacacctggatgttcaggtagaagtctgctgcaggggcggagtcctcatggagaacctctactagggcaatgcaggggggaaatgtggggttggagcccttccccccaccacagagtcctcactggggcactgcctagtggagccatgagaagaggcccaccatctagaccccagaatggtagatccactgacaacttgcaccatgcacttagaaaagctgcaggcactgtgaaagccatgggggctgtgctctgcagagccacaggcgtggagctgtccaaggtcatgggagcccaccccttgcatcagcctgccctggatatgagacatggagtcaaggcagatttgggagctttaagatttaacgattgcctggctgcatttcaaacttgcgtgggacctgtgtctactttgctttgaccagtttcccccatttagaatggaaacatttacccaatacttatacctgcattgtaccttggaagtaactagcttgcttttggttttacaggcttgtaggcagagagaacttgccttgtctcagatgaaactttggacttggaattttgacttaatgccgaaatgagttaagactttgcgagactgttgggaaggcatgactgtgttttgaaatgtgatgacatgaggcttgggaggggccgggagcagaatgatatggtttggctatgtgtacccacccaaattttgtctcaaattgtaatccccacgtgtcaagggagggaactggtgggatattggatcatttgggggatgggggatgggtggttcccctatgctgcactcatgatagttctcacaagttctgatggtttaagtgtctggctgttccctgccccctcctgccacctagtgaagagagtgcttgcttcccctttgcctttcaccatgattttaactttcctgaggcttccccagccatgcggaactgtgaatcaattaaacctctttctttctaaattacccagtctcaggtattccttatggcagtgtgaaaatggactaatacataagtatactaagtgatagaactacctagaaagaataaatccagattaacttaagatgctcttggaatcagtgtttcagtgtaattgactgtggacttaaacagctttaatggagaagttgcatcttacgaattgtttctttccctccggtcttagtcccattacttgaaagaaggggtacttggtaaatgttgattacgttattaaaaatattttaacttatttttagtaaaattgaataactctcttatattacaatcgtggaacccttgccctttagcaggccatttctcctaaggaatttcagacatccctaatcttaacatctttatataatgtacatactgttgtgcgagtgtatctttctaggggcccatttatcttaaaccgactttcctatgttcctatcatttaatgtgtttttccattggtaatgatatatttcttctgttccaggatgggccagatatcagatatcacacattgcaagtgtaaactaaagcccagagcagaaattcaaatggaattaaagtataaataaaaatataggtcagacagaatatggataggttgtaggaatagatcagatgccagatgtagattttaaaaaacatgttcagaaaatatagtattgaaaactaagaaagagcactccagaggagctttaaaaaaggagagcgagagaaagaaaaataatagaaaataaaactggaggacattgttaagtgaaatcaaccaggcacagagacacaaatattgcaagttctcactcatatgtgggagctaaagtaaattgaactcatggagatagagagtgggatgatggttaccagatgctgagaagggtaagtggggaggacaggataaggagggagtggtaaataggtaaaaaaaaaaaaaaaaataaaaagtatatagttagatagaaggaatcagatctagtgtttggtagcaccctagagtgattatagttaccaataatttatatttcaaaataatagttaaattggaatttagctaacataaatgataaatgcttgaggtgatggatgccctaatttccctgatttatcattacatgttgtattcatgtatcaaaatatcccatgcaccccaaatgtacaactattatgtagtcataataactaaaataattaacgaaaatgaacctcatctaataattggacatttctctcgctagctataaataccaggctttcagtcagctctacttttagtttatgaatgaataccatagaaacacctgtaatgtcctccagtcaaaggtgttgatcacccaaagctgagcttgttaaatttacagggaaagggtaagcaccaccttcagggaatagtcatagcctctcagaagaggagcatgacggaaggatacttaagagttttacacgctgagctggatggttctaagtatgctctcgacagattggtcagaattagcttaccagatgagttgctgtgacagtctgtggtgttatcttggaacacatgagtttgcccgagtttctgtaaatctacttgagcttaaacaatttgatatgtttattttccccaaacgattttatgttagccatcacgggtaattatgcttggcataagggactcttgcttgatataggggggagtctgttgtatccgagttcttagatcatcctatattacatcctatattaactctttaggatacagggattgattagggagtgatatattagttcacttacatagggagaaatgatcaactcagaatatttttgtccctttaaaacgtctacctctatgtaagagtaaagagcataggctcttgagctgcactgtctttgaatcctagctctgctacctaccagatgtgtgaccttaaaaactttacacaagcaattagttcgtcagtttcctcatttgtgcaatgtggttaataataaatgggttaatgtatgttaaatacttcatatagtacagagtaaagactagttattgtaactcatgctattgctgatttttaaatgatgtttattttaattcaattgctgttcccccttgtaaacgtagaaagaaaaggttaggaaagggagatgtagaattctactaacaatgacttatattagtagttgggccaataggccctccaaaggagattcatcttgtgggatgtaagtgcatatagtagaatatgtcatgaattaataacggcattcaaaaatgaagcaaagacctgtttaaatgacctcagggagaaatcagaaacttttacagcagtatctgctttaggaaatagctagtgatttaccatttcaaattatgaatggccaaccaatgccctcatcagttaggcattgacagcccattcttctagttctatcttcttctgtaccggtttcaggtgtttccttctattactccttgaattggctatggcatagtcagagtatcaaaatcactggcttagttaggacctcctagtgctctatataaatatattggtatttttatctttttgacttggaatggtttcatttaacatgtaagatacttagatgttgagcccatccttgagaagaataatgtataaacctcaaagataaaacaaaatcctctcattcttgatcagtgcttttagtttgagcatgtcacttggattactgtgtctctggctctagcattaaaatagtcaacctctgaaatagcaaaagtggtacagaaactcgtatattttggagagtcatcacagggaatactatttagttatatttaaccaattgttgttatgcatctttcaggggtgagacactgaaaatattgcaaagacataatcacagcccttgatataatagtagtttgaaaaaagccgtattggggcacagaaggagtagtggcagagtgtgtgtgtgtgtgtgtgtgtattaacaaaatgggattagggaatttgtcaatgatgagatgacatttatgttttcacttgctgaaaactttagaaatctacttagtttgctaggtttgtagtggcttctgttttcatctgtagtagttacaccttaagtgtgacaaactttcatttacttaatcagtttcagtctttctaaggctggcatgatcactaaatgagaatagactcatcttaattttcacatggcttcaaaattatagaaatattaatccttccaaaaaatgtttagatgtagtccaaaagatttgtctgtggtctctgaaaagtgtttcactggagataaagctaatccagtttaaagtaactttgtaatcaaaattaatattgcatgcgctaatcataggctctccatgccttcacttctagtcagatccaggctcattgggagtcaagtgccagagaggtcctgcctcaggacctttgtacttgctgatcctttaatatggaaatgtgttttctccagagagtcatcacaggattcaactgcttatttcattcaactctatttttaaatgttcctgtagttgaaaggctttccctctctaaatcctctcttaagtagagccaacctctccatgccttttgttccctctctttaccttgctctatttttctttataggacttgccatgacctgattttgtgtagcatatttatttgtccttatttttatttctagtcctagaatttaagcttcataagttaaggactttgtacattttattcactgctatatctcctggtcctaaaacagtaggaacttaaatgtttaatgaaaaacataaatgaatgattaaattactaatagaatctgtattccctctccaaatgtacatttggtattgtactaatgtatataattttatgcaactcataaagtaatcgacatatttatattgctttcaaaattagcgccctcaaatacatttaggttagaaaaactaaaattaatacatcaattgatcatcaagcatagaaaaggaactccaagaacacgtaaacattttacatctaaggtcttactatacttttggtattaatgtatattgtattaaatcattgtaaatgtagttttctattccgaatagcaatactagaggaatttactttaaattctacattctctgctggatgatcccccaaaactgctgcccagataattacagttccctctcttagcttgtcttccagtctctaatttcctcctactttaaatcattgttcacatgccaccacaattagtgtttgaagatgacaggtctaagcatgtcattctcttgttaatacaaccccatgttctttctaaacaaaatccggctttctatgcctgccttttattgcttcccaccatgtgttctgtacccattcttaaactaaccttcagttacaccaaccttgggaatacatgttcctgaaccacaaaagggtttcctccatgtttttatcttacagaagtcacttaccttagtacttcatgcatagtctgtactaagtaagggtttattggtgatgactatgtgttcaatcttttaaaaactttgccactgtcctagaacttaaagatgactattccatgaagctggtttatatttcaaagataaaatgtcatatttattataagcctcctgtttttttttttttctggtttttcctggatagtaatgtttactcaatttactaataaaactagaatatatcacttggctataagctgtagtaccacagaatttgaggtgacacagaaaaattattcatctgctcttatatctttccaagggcatgattagtcttgatggcctggtgcaactgaattctattaattcttatttaaatcatcagaaacaaagtgtgatctcgtgtcactgaattagctaaacaaccttgctgctttaacacataagtgccaaaatagaaaggagcttaaaacaatagtttatatgtagcccaggtataagtccaatgtaggtgttccttattggtgactgatatggtttggctgtgtccccacccaaattgcatcttgaattcccacgtgttctgggagtggcccagtgggaggtaattgaatcatgggggcaggtctttcccgtgctgttttcttgatagtggtaagtctcgtgagatctgatggcttcataagggggagactccttgcacaagttaccttctcgtctgccaccatgtgagacatgcctttcgcattctgccatgattgtgaggccaccccagccacgtggaaccgtaaatgaattaaacgtctttcttttgtaaatcgtccagtctcggcaggtatttatcagcagtgtgaaaatggactaattacagtgactaatatttttctatatttttctgcctttgttgtggctctaccttcttcacagatgatgatgttttttgtttttttgttttttcatatagccattgaagagggggaagcaaatacagaaaagccacagtgacttcttagaagccttgtggtagaggtgatgcatatgtgctcccttcactttccacatgaaggggatgtgtgctcatgaaacatgtatatagccatgcctgtctacaaggataatgcagtggctggctgagtggctgcttctaagtgaaaaatctatactttaaaagctggagaaaggacatggttgtttgacagcctgtctctgccatagttaggaactatcagcttcataaataaaactatctggtggtcttctcaatggggagcttaattacctcaagtcaataagaggaaaatatccattagattcaattctatgttaagaaaatcgtggtcccagtgggattataatttctaaaatgaaggaatgtcagtaaatttaatggaaccttaagtataccatagaaaaaaatgatacattctgacattgaattttgttgatttaaataaatttattgtggtaaccatgctggttcccttcatgacatatgaatggggaattaaataatatacacaatgctttgctgaaaagtgttcaatttgtgttagatcagatacacttgtcttggtgacaaaattggcacaaagctttatgaaacccacgagtgggcaaagattgtatcagaaatatctaacggtataaagcaattttgtttttcattgttacgatattgacacatctccaagaaacacatccagggatgaatagctctattccccaaattctaaagacagcatctgacggaaatctaatttcagtcttgttattaaataagttttcttagtgtctgccatagtagacagtgtttgcaagatagcatattcattttttaacatatttttcttttgtgtgttataaataaaattaataaactgtcatattctactggtatccactgacgtttcttagttttactttaatctcaccattatgtaaattgactttgacagaatatttttagttgaaacattgctggaaattgaataaagttatgtgtgtgtgtaactcctgtgaaacactcaatgttatatctatatctcttatcaatagttaagcctttatgaaaataattgattctttagcatggtgtattgcacctttctcccaaacagagatttacagacacatagtagggtgtgtatatatatagatgagcatcaggtataacacataaatgcttatatatctaattggtgttgaggtctgaattaatgtatttttgaaagcatcggttcttgtgacagtagaatcaaatacttgcataatgttttatagactagttataatccttacaaaaatcctattgacaaaatagcattagcttaatattccagatgagaaaatgggctccaagtaattagatgctttgttcctgatcaaacactaagtggaaaaaaacccacctcattacaaaattttcttgttgaaagacttcagactgcctctaaaatagaggagagaagaaatagtctgacactctaaattggatataaacgtcagaattgggactataagtctagaaaaagtaagtatgtttaatggcacatatagaacttacagtcttaacaaatgaagctttttggtcaattttggagtatgatcttctataacacggaaaatcattttggggttttttttcctgaataattcataaatggagatggactaaagaaaatataaaggaaatagcataggaaaattttgtaaaaacttatttggatattttatgatttttctacatctgttttctaaattttacaccagggttccctttaaatggctacttttttggaaaagaaatctgagtatatacccatatgcaaatgagcctcaaaaaatactaggtgcctttagcttctgttaatatgaaattactaattcatgatgagaatattttattttaatgttagcggtgttgcttttggttggaagccaggtaaatgtaatcctattactatgcctataatgcggagtagttttgtttaatggtatgtattaatgcggcattggacagcttgaattgaatcagagaaatggtgttggcaagcattaaagactttaagagaatgcaaattttatatgcctctttttattgtaaattgacaatatataattgtataaatatatggcatacaaagtgatggtagaatttatgaatacaatgtggagtaattaaatcaagctagttaacatatctatcacctcaaagacttttgtggagagaacatttgaagtgtactctcttagcagcttcgaaatgagcaatactctattaactatattcatgctgtgcaatgcatttcaaattttcatcagaaaaatcagctttgaaagagtgtatgcaaaaattttataagcttctcagatgatatgatcttatatgtagaaaattctagagatttccacacaaaaaacctgctagaactaataaattaagcacaattgcagtaaataaaatcaatatacagaaataagttatattttatgcactaacagtgatgcagtccaaaaaggagattaaggaaacaattttatttaaaatagtaacaaaaagagtaaaatacttaggaattaaccaagaaggtggaagacttatacactgacaactacaaaacaatcctgaaagaaattaaacatttatttttataaataaatgaaaaggaaccccaggtttatgaaatggaacactcaatattgttgttgaggtatccgagttactcaaaacaaactacacattcagtgccatctctaagaaaatcccaattagtttttctgcagaaatagacaactctatcaaaaattcccatgtaatctcatggatccaggaatagttgaaacgatcttgaaaaaagaatgaagttgaagggtcatacgtcctgatttcaaaacttactacaaagctaccataatcaaaacactgtggtattggcttaaaaaaagggaatgtagaacaatagaatataatagccctgaagtaaactctactatatattgtcaaacaattttccataaggttgccaaggttttttaatgattttttaatgaagccacaaatgttgctaagaaactgaatatatacatttaaaataaatgaagttggactcttataaaatacacaaaaattaagtcaaaatggatcaggaagtaaacgtggccaaaagtacagaacttttagaagaaagcgtagacatttggaagaaaacataaacattagattgggcaattaaatatcttggatatgacactaaaagctcaggctacaacagaaaaattaggtaaattgaaatgcatcaacattaaaaacttctgtgcatgaatgaacaccatcagagtgaaaaggcaacttacggaatgggagaagatgtttgcgaatcatatattcaatagggaattaatatccagactgtgccaagaactcctatatgttagtccattcttgcattgctctaaagaaatatctgaaactgggtaaattataaagaaaagaggtttaattggctcacatttctgtaggctgtacaggaagcatgatgctggcatctgctcggcttctggggaggcctcaggaaacataaagcagaaagggaagggtgacctggcaggtcatatggtcagaacaggagcaagaggggtggagggagatgtcatacacttttaaacgaccagatttcataagaactctctatcacgagaatagtaccaagcggacagtactaaaccattcatcagaaatttgccccagtgatccaatcacctcccaccagacaccaactccaacattggggattacaattcaacatgagatttgagtggggacacagttaaattatatcatcgtagaattcaacaacagaaaaacagcaattaaaaaaatgaataaatgagttgatcagaaatttctctaaagtttggccagtaagaccatgagtagataatcgatatcgctgatcattagggaaatgcagataaatcccaaatgagatagcacttcacacccattaggatgatgattattttaaaacaccaaaaaaaaaaaaaaaaacccagaaaataaatatggttgaggatgtggaaaaatttgaacacttgtgaactgctggagggaatgtaaaaccttgcagtcactgtggaaacaaatatgttggtttctcaaaatatagaacgtagaattaccatgtgatccagcaattccacttctgggaatatactcaaaagaattgaaaaaaggaccttcaaaatatatttgtacacccatgtttatagcagcattattcatagtagcaaaagatggagcaactcaaatgtccatctgaagatgaatggataaacaaaatgtggtaaatgtatacagtagaatattattcagccttaagaaagttctgacacacattatagcatggatgaatcttgatgatgatatgctaaggggaaaaagccagatacaaaaggataacatatgattctatttgtatgagctatctagagcagtaaaatgcatagataaagtagaatggtggcctctagaagctgggggagagaaggtatggggagttatttaatggatatgaagttttttgggggaagataatttttggaggtggatggtggggatggtgacacaacaaggtaaatatacttaatgctgataaattgtatgcttataaatgattagaattatatgttttatgttatatatattttaccatgataaaaacctataagctttcttgtaaagttttagaaaatgtttggattcataagtgttggatgattgagttttatagtgtaaatttaatgtagttgtgctcaattgtcaattgtatgcctattgtctgtgagtatatattttccagattgttctctaaacataatttttaaccatttagttggaaaaaaaaaaaacctcaacttaaacccaaatggaattatgtagtccattcagtgcatactgtgaaatatattagtaacattttattcattttaaagattttcgttatcagtttaggaagaatgataattttataaatccatagcatactgttgttgtgtgcgggtaatactcattatttaggctgtttttaatttggggtcttttttaacagataatcaacaaacgttttttatttgcacacagtactcttagtatttcgttttgcttcagtaatagtaaatgaggctggggtttggagagcacgattgcttttggaaaagtcaatagagacatgtttttatcgctactgctttttttctatgttaattggaatttgacgtaaaattgattctgaaagatatcaaggtagacacttgaaatatagattggacaataaggttggtagaccattactgtgctttgaactagagtcattaatgtgattgtgaaaatttttactttgtatgttattcatcacttttctcccttagtggtgtttagagcatgatgagttgttactgtactgacaagtattagtctagtagtaatttctcataggctgacaagtgccaaaattcatcctcacatatgaatacactaaagcagacaaacactgttttcatctctgacactatctacagtttatcgtgatacattattttggcctacagggtcacaggcaaattatatttaatcactgctttaaactaaaacataactataaatatttttgcactctttaaatcagcataacaatccaatagacttcaagatcctgagataatatttaataacattaaaatgatttaaaagtataacgattgtattaaataattctgaataaacaatacttttgaatgaagaagattaattagcatgatcattatagaaatggtcctattaatacaaagatgtcaagagtcatttctggttcaagtcaattaagctacgttttaattgaaaaaagctgttcattgtgtacagcggtagcactcctgacatatcatataaatgaccccattaatgcaggagaaataaggtcaactgagacatttttactgaaaccaattatgttacattttaattgaaaaataaaagctgcttttattcaaaggaagcaccactgacactccatcatattccatagcctcctaatattgcagtaacttcctaagcagtctctcagttcttcgcattatacaaagttatctttttactacattaattaggtcatgtgttccctatttaacaccttctgaagactctacattgtacttagaaaaatgtctggagtctgaaagcagccagcaagaccctgtgtgatctgtcccctgcttgcttcttgatctcacttcacactggttcccttacttcaccaggctccggtcaagcaagaacatacttcttctccctctttatatagctgacaacttcctgccattcagtctgagccgaaaggtctcatcttcagaagaatcctttgcagtctaccatatgtaaaagagctctcctgatgagccctcccagccattcctgtatcctattcacacttcttgctttaaaatcatcatcattatctgaaattaccttgtttgattatctagcttatttcttctctgcttcccctactagaatgtttggtgtcaaggactttgtccgttggcttcagtactgtatagccagtagctaggagaatgccgaagagatggtaggtgaaaaatgtttgtggaatggataaataaatgaatagcaatagtacagaagtatgccatcttatttgttaataggtgaccatcggttgatagagtttcatttctcctgattgcttaactcagtaacactctcctgcaggagagctagtcaggactcagggtttttttgttttttttgattttttttttctttttttttctttttttgagacagagtcttgctctgtcacctagactggagtgcagtggtacgatctggcctcactgcaacctctgcctcctaggttcaaatgattcctcctgtctcagcctcccgagtagctgggattacaggcgcgtgcaactatgcctggctaattttttgtgtttttagtagagactgggtttcactgtgttagccagaatggtctcgatctccttaccttgtgatctgcccatctcggcctcccaaagtgctgggataacaagcatgagccaccatgcccagcccgaggactcaggtttaagtatgtgaacagatagttcagaagacgttataaactgttaatggaaagtctggaaggaacccagagatatgttttgtttgatctacaccttactacagatttgggtttctgttagcagatctagcagctctggggcaacattctgcaatggcaccatcctggtagtactgaggagtgctactctcctccctcaaagcgggcacattactgttcagtctggagctgcactcgccatacacacagtttatgtaactccactgacagactctgccactccagtcatttatggcatctgactttgattccacatggaaatctactgggtggacctgtcacatttaaagataatcatcatcatcattgtgtatgtgtgtgtataagttacattggccatttttctggggactgagtctgtctactccaaaagctgtgaaaatagtaatgattaaaagtcctcagactctatgattgtggaaattctttgtattctagaagcacacaattctaagacttctgagtgtctctcttcagtctcctgtgaagagcatcaccgatttatcactaaatgagcagattatatactggggatttagtgtagaatgtgccatacagtagctgtgcttcttgaagaaatccctggataggccaggtgggtttatggtaagagataaaattaaatagacgctgcaaaaaaaggagacaacattattaaagtcacaggaacaaatgacacttgtaaacatcttggacatgagttgataacatttaagtgtagtccaaagagttcaaataaaaaggcattgcaatcacttgagagagagagagaaataatgcccggagagtacatttgggctatattttagagaaaggccttgataggtagaaatagggaagaatagcattccaggtgaaatagcaaggcaaaagcaccaatgaagaagaaataagaggaaggcatattcaaggtatagaaaatcatgtcattatgtgaggtacaaaaagctatcgagtgtgcatttatatatgaggtatcatgctaggaacccaggatagctagatcaaaaggtatgcattaaagacattttgactaatttccaaatgatcataatgatgcctatatgcaacatcaatatatgaagtattcagtttcccattccttgcaagtaaacctgaatatgtttaacattatatcactctgttcttccctcctgcaaccataattcataagttattttcaccaattcattcaccaagcatttattgaacactatgtatcatgtctctgattggcactggggaaacaaatgtctctaatctcaagggacatacagtagaatgggagagagatacagttcctttaaattctggacctttccatttctcttctattttcaatagagcttgcagtcatggaaaatttattctctgtggcaacaaagtagggcagatatttgccctggaaggtgaagagagatagagaaggctttctgcctaacatttatcatgaggtactaacaaatatgacaattgaataatgctgttaaatactatgtggcatactgattccatttcacatacttatgtctcctctttttaatagaaggtagtgtaaaaagaagtcctgtgttacagtaatgtttcttttattatctaattgatccttgggtacgttacctaataattgggtatgtacatctccacatacatagcagtggaatagtaatagttggggggatttttgtgacatttaagaagaataattacaagagtcaaaagtataatataaacacaaaataggaactttccatttttcaatgcagatttattcagcatctttgcttctgattccatgtatttttctgcttcagaattctttttttatcctctatcttattttacagttaataatttcctgagggactactttctgagtggaaaattgttagaatcctgaagaaatgtatcacatgggcctgcctgggtcttcccccgccccccccccccccccaagaaaaacctgcatctgccttaaacataagatccagtagtcagtatgaaattcatcaagctaaagcttatctcgtctgtagttgtagctctctgaaactttaaaaaaggagttttaaactttgcatatctgaatttctgaggtagcattatatatgaaaccaaaaatatataaaataataagaaaattgctaaagaatcactttgtgaaatgatgaatccatttagcttagttcttctgtttggatatgatagccttattgccatagagaaattgaggtaaggcattaagagaacaagcaaacaattttgcagtaactaactcatctctcccatgttgccaggtgtgccgcatattgctgagcagtgaaaggattaagctaggaaagaaagtggggaaagtgctacctggaaatcagaatgaacattgaatatagaaatgcatctaagggggaatgagaaagagaagagtaaattaggtttttcttgagtcctgtctttgttacttccacattttgtctacaggattaagcattcagtgcctgataagtttagtattgtgccagaggaccccagagaaaaattagaaatgatcctttccttctagcaactttcagtgtaacttgagagtcaggactgaccaaaatagttcaataggtctgaagtaaaattatttgtgaagtagtaaatttcactttatagtgtatgaatgctgtagaaatatatgagagaaatcaacaagggctgtgatggaaaataggaaacatccagaagtagaagttgagctgaaacttaaagatagttagaattggataagataaaatgagtattcccagttgcaaaacaatgtgagagcatgtttcgaaatagagaagagggatgggcataggaaaaacatacagatgaagtaaaagagggcattttatcttttttatttttttcattttacatgtctgttttgtttgtggacgcctatttggtctcattgttctggctttgggagacaggcaggggatgctgcggagcacatggcccctatttgtggtcgttttgctccaggtgaaaataatagccaccctttattgaacacatcctgtgtttcaggcactgtgctaagctcttacactttgttatctcgtaatcttgagaatacctgtgtgagggcaaattgcagtaagagtaaatggggggtttgattccgaagtctgagattcttgcctttatgaccactgacagttaaggggcttgttacataattacaggaactcaagagtcttggtcgttgaataacaatggatcaagtgctgtgctgtgacccattattttatcaagtggatggaataaaacatgactactgtgttcatttggatgagtaggagaatgctgaactttgaaaggttatggaaggcaagcctgtagagaggtaccaaaatggcatgtagcaacacgcagggaggagaaagacctggatttaaatgcagtctctgccatctagagctgcgtgagcttgagaagtctgcatcatcttccctctctggcccctaaagctaaagaattaaaatgtatcaccactgctctctaagagttcagtttaagtgacagcaatagtcaagagtgtcagtttgagttttcccccaaagcaaagcctgacagaaagccatgattggctgattatcaaagaaactagtaagaaaactcaggaacatgtgggacctggaaaagtgagacaaggaagaaggaaaagctaataaagataacattgttgaactgatgaccataataggtaactgtacctcaaccttgcctgggacattatagaaccttatagaactgtcctcagaaatgtccctttgaaggacaatttattttcctccctcctcttcctcctcctcctcctgttgctagagctaggaagtgaaagggtgttaaccctctaacagcagaaacaggaactgcagcaaaaatgagagatgggttgatgggatacagtgcaaaatacaaagaggcatctactgttcaaaataaacctataaaggaatctgtattagtctgttctcatgctgctaataaaggcgtaccaaagactaggtaatttataaaggaaaggtttaattgactcatagttctacatggctggggaggcctcacaatcatggtggagggcaaatgagcagcaaagtcacatcttccatggagacaggcaagaagagaaagcatgttccgggaaactttcttgtataaaaccatcagatctcgtgagacgtattcactatcacgagaacagcatgggaaagacctgccgccatgattcagttacctcctaccaggtccctcccatgacatggtgggaattacgggagctacaattcaagatttgggggaagaaacaaccaaaccatatcagaatcgaaagaaaaattataaagtcaaagtagaggaaattctggagagccttgaaagttgggctaaaactagatagaatgtgtatgtctcaacattttctattatatccctgaatcatataacttgttaagaatggggttacacaaaatttcagttaggttggagagggaaattcaagagaactgttgggtgtatataacaagactatagttaatagcaatgtattgtatgcttgaaaatttcaaaaagaatagactttaaatgttctcacaagcatgtgaggtaatggatatatcaattggcttgattgagccatttttaaatgtatatgcctatcaagatatattgtatactataaatatataaaatttgtcatgttaagtaaattcgaaattagaaaaaaaatggagctaatctctttaagagttaaaccctgaattgtagggaatttcttgctgacgaagactaatttggtcttgaagagaatttcatgtcaccatgaacttatggcctgacttcaaaccagtgatgagctgtggagggatatagggcactttgctttccatcagatcctctcttaagctgttttgcatcacttaattctaactgtaaagttgggaaaatgtagatggggcaagtgacagcatatggtttgatatatacttgattgtatccataagaacatcctcttacctttttaataagtagcttggagtgcttcctgccaaggctttcaccagttatccagaagattaaaggctgaagtagtgattgtccttggaatgtccctctatctatgtgtagatctgtggttttattcatttgtttcccaaattgatccacaaggagattaatcttgtatttttttcctgatgacttttataaactagatgcgtaagacatataatattgacatcatatcaagttgcccatagggttatttaaatatttgaagagatgtgtttgttctcttacactctctgaatgcttttggtttttagcgattttattgtcatcaaaaaccatattcgactacacatttttctgacctactagacattcacatttagctttgggtactttgtcattgtagaagcaagtataaagtaatgaaatttatgattcaatcagaaaacaagtattgaagctgctgaaatatgacgttctcagctttatttcttctacgaaaagtccaggttaatgtttataaaatatttttaaacttttttgtctgttcaggactgaatttcttgttgagccggaatggtgagataattctttcttctgtggaacaaatgcattttaatgatagttacttatatgaaaatgttactaagatttaatttatgcgcttaatgctgcttaaaataaatgtattcaataacaaaacaaagccaatagccatagcacattaattattgaatagactttctgtagttactgcaactgaatgacaggtagtaagaccttaatatttgcaatcacaattgtattcttctttgccctagattaagcttgctgattacagtgcaatgaagaaaaattaattagtttgctccagtggagcagttaatatagcacaagcgaaacccataccctgcttcctcctgtaaccaacttgttttcacttactctgccttttgatacacaaccattttcttgatcacttcccaattgaggaaaagtttaattaagtagctaatactatttagaaaatatagtgctaaggaaaaaacatgttattaaattcaaaccattgatatttttattgctatttaacttatattttatacctggcaagcaaataattgaatattgtttgaaaatatttgtaattaagaactcaagaatatgaaaacatcattgagttataaaacatgtattactcctcaaagagcaaatattcctgtgttgggctgctcttagttggagtaaacacattacctgcccacagggaacttttcatctattagaattcagaatacatttcagggattcttaccaaaaagatttagaatacagctatatgaatttatagaaatattttaacttcagaaggattgtgtgctcacttccgtatcttcctttaagattttagtcatgttccgttttttgtgttttttttccttgtctgaagacaatatttttagaggagagaatttctttgaaattgatactgtaagtaaatttactgtatttacttagaactactcattcacccatacaaaaaaaaagttgagctttcattattgagctctcctcattatgttataaaggaaaaagacattgtccttatcatgggagacaagcagatacatgggcaattcttcagcaatgtgatgagtagggaaagacatacatgatgtgggaaatagtgttttacagtcaggtcatgcattgaaccaaaactcaggccgtaaggaaaggctttgaaggggcagtggtaacttacctgacatgtaaaggagccagatgaaaaggatgttgcaggcagagaagctgtaatgtacagagaactgaaggtaaaataaaatatcagcttatggcttggcaaacactatggggaaagaggcacagaagtcacaatgatagtgggagccatctgcacaatgatttaatggctagggtgttatgtacagttatgtgtcttgtatattgcatcatttctataacagtataaatgctattgagtataaattagatatttattgacctcatattttacagatttgccgtgaaaatttctgtatgtttaaatctgcgataagtttgttattgactcattcatctaaattaatagcttgttcttcagaaaagaagttttgagactggttgtgatggtctcatcaggttgaagagatcatacttttactgtggcacctattttttttttttaatggtttatttctatttgagtaaaacagtggctaaggttctatggtatcgggataagatggtgataagtgatctatatgacagagttggcagaggaattaataaccatattgacttgggagagtgagctctgtatatagaatacacattttagtcaggagggcagagtggtaaaagtctgagatcttgagatgcactgcttgggtttgaatcctagctgtattacttaaaagctgtgtggccctcagaaagttagtcatactgtgtttcagtttcctcatctgtaaaatggcgataattgtatccatctgataagattgttttgaaaatatttaagtttaacatgtatgtatgtagttacatacatgtaaaagtatttaaaaaggtgcttggtagatattaagtgaccagcaactctaaatattgttttattataattagtaagctaccacaggttctgtgctgctgaataattgatcaataccttacataacatcagcaaaggggtaattttcaattttgcagatggcacaaatctgggtggggggtcaaaatgaagatgagaatttttcatgataggctaaatcacggggtcaaaacccacaaaatagaattgagcagggtttggtaccttcttaattgcttgcttgctttattttcaatggcttgttatgtaacaccaaccatgtggtcaacttgctaggttatataaaggtgaataaggctcggttccttccctcaagaacatattaacatgtagacgcaagtacagaaagggagaactaacattgtattataaatattctaaaaatgctaaattaacagaaatatgatacaaagtatagtataatgtagtatttagaggagataatggtttcacactcctttgctctgacaaagcatcaagagtctttagttatttgtgtcagattttaagaaagccaattaaatgttatagaacacccacagctgagggaagaatttgtactgaagcttggttggagtatactccctgtgtggcttactatgagtggcagtgcagagggtttgtggtggtcaaataggaaatctttatgagtatgaaaaacaaatttctaaggtagactcaatgcaaagtcgaaccacatctggaagaactataaattccataaatgttcattaagcacctcctatgggcaaagtgttctgttaggcctgaatgaatttattgaagacataagaaaaggctcatgtcttggaatatattgtcttttgaggaataccagcataattatgattgtataatagtttaattttatttttgatgtgtactatttaaaattcagagtgctataaaaatagtaaatcagggaatctgtatctggaggaataagaaatgaagtctttttgaaggaagtgatatttagatggaagtctgggtactagcttgttgtggagaaggaagagggtaaaggcatgagggaggaaaatacaggtggggatggaaaggtgttctaagcagggagaagtcagtgcttgtgtattagtccgttttcatgctgctgataaagagatacctgagattgggtaatttatacagcaaaaagggtttaatagacttgcaattctatgtggatggggaagcctcacaatcatggtggaaggcaaggaggagtaagtcacattttacaggaatgacagagggcaaagaaagcttgtgcagggaaactccacttacaaagccatcagatctcgtgagactttcactaccacaagaacagcatgggaaagacctgtccccatgattcaattacctcccacagggatcctctgacaacatgtgggaattcaagatgagatttgggtggggactcagccaaaccatatcattccacccccggcccctcccaaatctcatatcctcacatttgaaaaccaatcttgccttcccaacagtgcaccaaagtctttactcattccctcattaactcaaaactccacagtccaaagtgtcatcctagataaggcaatttccttctgcctgtgagcctataaaatcaaaagcagattagttacttcctagatacagtggggttacaggcattgggtaaatatagcccttccaaataggagaaattgtccaaaacaaaggggcttcagggcacatgcaagtctgaaatccagcagggctgtcaaatcttaaagctccaaaatgatctcctttgactgcgtatctcacatccaggtcatgctgatgcaagagaggggttcacgtggtcttgggccactctgcccctgcggcttttcagggtacagcctccctcctggatgctttcatgagctggcattgattgtggctttcctcggtgtgtgttgcaagctgccagtggatctaccattctggggtctggaggacagtggccctcttttcatggctctaatagacagtgctctagtagggtctctgtgtgagggctctaaccccacatttttcttttgcactgccctagcagaggttctccatgagggccctgcccctacagcaaacttctacctgggcatccaggtttttccatacatcctctgaaatctaggcagaggttcccaaaccgcagttcttgacttctgtgcacctgcgggctcaacacgacgtggaagctgccaaggcttgggcttccgccctctgaagtaacagcccaagctgtacctcggccccttttagtcacagctggagtggctgggacacagggcaccaagtctctaggctgcacaccacagagggaccctgggcctagcccacaaaaccattttttcctcctaaactccagacatgtgatgggaggggctgccacaaaggtctctgacgtgccctggagacatttttctcattgtcttggtgattaacattcagttccttgttacttatacaaatttctgcagtgggcgtgaatttcttctcagaaagtgtgattttcttttttatcacattgtcaggctgtaatttttccaaacttttatgctctgtttcccttttaaaactgaatgccttaacaggacccaagtcacctcacgaatgctttgctgcttagaagtttctcccaccagataacgctaaatcacccctctcaagctcaaagttccctataactctagggcaggagcaaaatgctcccagtctctttgctaaaatataatgagtcacttttgttcgggctcccaacaagttgctcatctctatctgagaccatctcagcttggatttcattctctacatcattatcagcatcttggtcaaagctattcaagtctctaggaagtcccaaactttcccacattttcctgtcttctgagctctcaaactgttgcaacctctgcctgttacccagttccaaagttgcttccacattttcacgtgtcttttcagcagcaccccactctactggtaccaattcactgtattaatttgtttttatactgctgataaagtcatgccagagaatggataatttatacaggaaaaagagtttaatggacttagagttccacgtagctagggaagcttcacaatcatgctggaaggcaaggaagagcaagtcacgtcttacatggatggcagcagacagagagcttgtgtggggaaactcccccttacaaagccatcagattttgtgaaacttattcactatcatgagaacagcacgggaaatacctgaccccatgatccagttacctcccactgggtccttcctacaacatgtgggaattcatgatgatatttgggtgagggcacagccaaaccatatcagtaggtataagtaaaataggtgaagggtggagatcaatcagaggaaagcacaccaaataggaggacaagttctcaatccactgcaaggatttgatttgtagtttggctttcaggcctttaactgtcttcagcttggaagtggggtttcactgggtacccacccctatctgcctaggagtttggctctgcttcctgtcactgtcatatgcacttctctgtggtttccaaaacctgacacagggaagaaatacaatacaggtatctgatttatagcaatctgttataaattattgaatgaatatcatattttaaattcatacctgatagatattttgcacatttcttgatttacttctaaaataagtggatttctcttctttccaaatgtaaatcaaatttcgcctaacttcatatgaaacacgggaagtttttctcccttttgtcagaatttttaaatgtatttatattttaatctgaagaaactagctttctcaaggatggatagagtttgaaaatgatagacatgattcagttttctaactctaatgctatgctagttttcatagagtttatgattaacataaatgtagcaatatacatgattttccgttagggaaaaatctctgtttattcttaatgttgtaaatcacaagtcaataaacacttatgagtgtcttctatatatgtagaaatgtactaggtttcatgggtaaaagtgacaaataaggcaaggcgtctgttttttcatccaatggaaatggctcacaatcacatttcaaaaaagatcagtgaactgtatataactacctatgtcttaatatgaacaaattgtgattcattggttcatataacagctgcaattcctaatacctaacatcaaatcttttttgctatgtgtggtgttagccacataaattctcactattgattcaataatgagttttttggcttttaattgtgtgtcatttttttgttgtttacagacatgataattttacgtagttctgccttggtgtctacctcaattatcagagtcttaaagagattatagcaactgggaaccctaaaagccttcagcaaatcttggctttagccaggatcctcaaataatgtccaaacgtgttaagaacttgaaatattgaacatttccacttcatttccattcattctttccatttccttaggaaaattctaataagaaatgtaattcttaggagcagagagcaggggaagaaaacaggataatttataaactgtttaataaccttgtgagcaattgaatgttgaccatataaattctggataatatcattattgtactcaggttggctgttaaaaagtcataaaggaaagaattttaggcatctatttctagataactattaaaatggtgatcttatcattgcataccatttagctggggagacagaattgtatttaatgaaatgactcatttgttgtattggattcctgccaaattatttcatggtttgtcaaatgataatttcacaagtgtcagtgacaagatgttggacattagttttctcttttcctatctgctgagtcacagttctcaagggatggatattatagtgattcaatcacaccttagattttggcttacatttactaatcagtctagtaaatttggtaggggggaaatcgtgccatagcatataaaataatgagttccatttcctccccacattggcttctattttttgggttctgtatgtacctaggacctaatggggcacttgccacgtaggtccccaatgggagaaaaggttctgttaattactccatcacattaaacagtccagttagtacccatagaggtgaggaagaatgtgcttatgttttatgcttcaggcaaagtagctaatcagagagctgtgaacaattgtaaggaagtgacttgctgcctggttctctgcaatgactgatgacacagtctttttacatcacagaatgtgtaaaatttgttcacatgtataagctcttgttactttgagagggcaattctgggataatttggttgccatattatacttagtcaatccctatgtattgataatctgttttaatttgcatgttgatatacttactgacttacctaataccatcatttatggtttgagatatcattcttaatttccctttaataatacatgtaatgcatgggtttacctagccctaagactcatttcaaaatatattttctgaagttctgtagatgtaattattaaaatcacaaactttcaaactggactcataccccagctggctatggtacttaatgaaaattaaactttttgctcctcagttttcttatctgtataacaggattaaatgccccaccctcgcagttttccttttttctttttcttttcttttcttttcttttttttttttttgagacggagtcttgttctgtcacccagtctggagagtgcagtggcatgatcttggctcactgctaccgctgcctcccgggttcaagcaattctcctgcctcagcctccccgagtagctgggactacaggcatccgcaaccacacctggctaattcgtgtatttttagtagaaacggggttttgccatgttggccaggctggtctcgtacttctgtcctcaggtgatctgcctgcctcagcctcccaaagtgctgggattacaggtgtaagccaccacacctggcctacactttttctttaaggataaaagggaaatacgtgtattaccattgtgcttgtcatatagtaagtaccaaataaagagtagcttctaccattattaaaagctatcctggcttttttactattattaaaagttattcaaagcctacatatagaaggcatagctatatgcctttgtgtcacatgaatagtcaacttttctaattttttctgtggctgtgctttgctctcaaagtgtggcctgcatcagagtcatcagggaaggtggtggttaaaacggattcctccccggcatgttggctcacacctgtagtcccagcactttgggaggccaaggcaggcagatcccttcagcccaggagttccagacaagactgagaaacacagcaaaaaatacttaaaaaaaaaattagcgaggtgtggtagtgcaaacctgtagtcctaactattcgggacgctgaggcgggaggatcaggattgcttaaacacaggagtttgatgctacagtgagtgcatgatcatgccactgcactcgagcctggacaacagagtgagatcttgtttcaaatacagtaagtaagtaaataaataaacccagcaaaacacagatccctaggtctcactctcacgcttgattgagtatgtctaaggatgtgggcaagattctgcagccacaactgtctcccaggtgaggctgatggtactcgttctccaactaaagtttgagtagctttgccctggagtagctgtcccaaacaggttaatcctcagaattgcctgggaagatttaaaatatatttcccaaacataactgaatcaaaatttgaggagacattgtaaaaaatccatttgaaaattgttgcgcaaattagaggttctcaaacttgagtgcacatcagaattttctggaggccttgttaaaacagattgttgagatacggaatcaacctaagtgtccattaacagataaatgaatttaaaaatatggcatataaacacaatggaatattattcagccataaaaagaatgaaatcctgtaattggtggtaacatggatgagcctggatactgttaagtgaaataagtcgggcacgaagagataaatatcacaagttttcatatgttagagctaaaaagtttgatttcatagaagcaggcagtagaatagtggttagcagaagccggggagggtaagagggaggagagggaggaaagggacaagctagttaacagatacaaaatgataagctaaataggacggatatgtactagtgttctaaagcactgtaaggtaacttcagttaacagtaatttattgtgcatgtttaaatagctagaagagaggattttgaaacttcccaacacaaagaaatgacaaatatttgaggtaatggatatgataattagcctgatttgattattacatgttatattcatataggaaaatatcactctgtacctcctaaatatgcataattatgtgtcgattaaacattaaaaagaaaacacagatttctgggtctcactccctgagatactaaccaagtaagtctgggagagtcctgaaattcggtatttctaaaaaggtcccaggtgacgctgatgctggtctggatccacactttgagaaccatagcctgccctagaccactgcttcttaactcattttaaaattaaggatctgtgtgagattctgctggatggtgtagattttcttgaaaaataaaaaacgtgaacatagtttccatatactttccagtgttcatggatcccttgaagtatgtctatgattcttgtatgaaagcttgactccagatagaacgtctttgagtaacatatcccaggttaggaatggaattctctggggctatttgcaaatctgtctaaacatgggaatatgccagtaacattttactccattacccagagaacaggaccaagtcatgttattacctgtagaatgataagagactttcaattctaagaattatggcttatttttacaacttgttggaatatgatttgcagatttggtgaaaatggtagttacttccacaaagatgtttaacaatttaaaagttctagaagtttgtgtttcctactggctttattctttatttttactcttcaaatctagctgttcgctgtctttttcctgaaacatttttattaaggaaaatacagaattttgcagcttatcagtttaaacagaaaacatccctgaaaagtcttcgactatatgactacattacttatacaaatcgtgatcatagtgaaactgaattactttgtaaataaccatgattcattactataagcagggttttgaaattatgactacctcgagaaaacttttattaagaataaaaaagcaactatctcagctggaccaataatagaaacaccagtatattcactcgctttttatttctcaaagcacatttgtggcttgtagccaagaattcattgcattgaaggagtgtttgacaagcagtattgaagctgtaaacactttgaactcattacagtgtctcaccataggaacttaactgtcactgaagacaccctgtctgtgaaaccatcattcctacaattatttttacctttgcctgaaaatatgcttttgtgctttaaggtatttcaaaagacaagagaaagatggaagctaaggaggctatagggatttcctgagttctgtgagtgctgtgttgatacagaacaagatcagaaacttggatatatatgtttcaacttaaaatgctgattgatcatcatgacaatagttttatagagcatttgtatgggggtgaatgtttgaagttataaaaagcattgtaatgttactcattcatgggctgaacaaacatttcctctttctctttctctggctttcttgccaattacttttttcttgccaattacttttttcttgccaaaaacaactgagatcacccccttaagtccattttgaaacaaacttagcaaggagtggttgttagtctgcaataacaatctacatctcaaactcacatccttacagttgttgtgtaggtatcatagctgcgtgaaacagtgaagtgtaagattgtgtctacagtggtctggaaaatttgactcataatcacatgtagaatacagtcctttaagaactctcccaccccgcatcactgccctgaagataatgagccaatgatcctgatggtaatctcttctaaaatcatacgtatttgagaaaaattgtatcttttcggagactggtaatagtccagatgaaaagtgtttatatcctgaacctagagtattgacaaagcagatgaagaggattgattgggatggagaagattcattgatgggacttaaggaatgactagatatgacaggatagggaggtgaagtatgctaggatgatctgtatgataatgtcttacacaagtgaacagaagtccagtttaaataacgaggtttggagggagggagtaaagaagatggatttcatttttcttaggtctaatttaatgtgcttttggtaaaatgtctactaggccaccatgtatatgaatctgaaccttaaaaaggaggtttgagcagataggtgcacagtttttaatcattagcatatttaacagttgaaaccatgagagaatatgccttatgagaagaagacaccaagatcacacaatgctaggaagaccaaaaaggttgtggcagagaggtgggagggttgatcatgagaggaataattaagtactaaattccactgaaaacattaagtaagatgtgggttaaaatagtttattagatttggcaaattggaagttttgataatattcaaaagagcaactttggaggaatggcaaaaaaaaaaaaaattgtaagaatggttatccttcctagaagatggttgcagaaatgattcagaaatagcttgtaagtagagggtaactgaaaagccctgagtgtgcttactagctggtgagagagggtttaaagatgaatatgtgttccttaaatccattttgtgtgtttatgaggacagggtaaatagtctagctaaatcaccacaccctgccctgtgcctagcatagtttctatatatttattaggcaccaaatattttaggtatatatttttttatgtaaaatatatagggaactgtgtgaggccctggaagaaacacaatgtctattttcattgaaaaagagctacattggagagactaaccacccatcactcaatactattttatttagttgtataagtaatgggtgctatggcagtttatgacagacagacctgcccttatcttgggggaaccacagaatgctttacagaggaagccatttttaatgttctactgagagcaaaatagaacttcctcccattcctcacccactgaacacattccacagagttaaaaactctgctttccttccacggtcacttttcttggcattcagaaattattggaaactgtaactatgggttcagtgccaacaacattctaacactcatggttagaatcctaaccagaaagagtacaaataagggtcctttcttttttgattttggctcagatatcgatgttactaataatgataataaaataatagtttaaatttaccctgtctttatgattttcagaatacttcccccttctagtttatttgggatgagatgctagggaatatgagtaggaaaatgataaagtgagacaaagaaggaaggaaagtcaatgaagactacatttcaagagtttaaactgtggtggacaactggcgctcaatttgactggggacttgaagaaaattatgtggaacacacacctcagacttatcctttgaagagatgagaatgctaaggtatttatacaccaactcctgctggtcatctgttggcagatcccgggaggggctgtgcattcactccctagcatttttgatctattgcatgcactccggaagaacagactccagtaggcaaagagatgcaggagctggcaggtggaagttggaacaatgtccactgaaatgcgaaggactcagaggaagagacagggtatcatcagcaccagcctaatggggtttgaatctccattttgccatttactagcagtgtgatctctggcaacttacttatcctctcttggccttcgtttcttcatctgtaaaatggggatcataatagtatctacatcgtaggattgcagtgaggattaaataaattattcatgtaacaattttacagaagagaacatgaaaatttcgaaaagattacttacttgtcaaatatcacacatatgggaagcaggccaaagccttgattcttggccccagcctttttccttatacctactgcccaatgtctgtgttgccttgtatcttcataatttacttcccattttctcattgcttaggtctcattcctgattcttttgtcccatttactctcctctaaacccttgtgattgtccagatgagctttagcttgggtgtctgtgtatcccttctgaatatttcatgcttcggccttgcccagcagcttaaacttacactattaactcccggtcttctctacctcgcatttttcctcttacctatgaggcatcttgacctataatattttcacttccaccagctgagtctatctgtggcacatgattacttgtctgattccttgttctcatggaatccttaggcttctctgatgtattttatcctattggcattcacatcccagtgggcacgaagaatatttaataaaaacattggctttattttagaacggaataaacacatcattctttcctcctaaaaataaaagacatattagttggattgtgtcattactgtagagtgatacaagccagaagatgcagtgacaatatcagaatggtgtgttatctgttaccaaagggaatgggtggtagctgtgtaaccaggtcatcatagtggcatgaccatagccaagtgtacggcaccatagtcaagggcactgaacaggtcattagttgggattgagtcaagagttggaccatttgacatggaacacacattctaaaaatatattaagttggtgcaaaagtaatcacggtttttgccattactttcaatggcaagaaaatgcaattactgttgcaccaatctaatagtaacataaacatcaagcggcttcaacttttgcctaacaagtttatttaaaaggttctaggctagtcatgtttaaaatggaacagctttattgagatataatttatatgccatacaatcatctgtttaaagtatacaactcaatgtttttagtatattcacaggactatgcaaccaaatattgtgttggtattataccaattagagatatgacaaaagctttggaccctctcatgcacatttgtacaaacacaaaagaatttgcatatgataccagaaaattcatggacttctctgaagtccatttatatgcccagaagtactactcgttcagccaaactctatcttaaggcagctattaattctgtttgtacaatccagcagacagataaggttgttgatcgtcttatggactcatggatatcaccttaacgacaacaatatatgtgccaagtctggctcctaaagttttaggattttgtgtttaaaaagggggagaaaagctttagtatgtttcgaatcctaactgacagtgagtgacaaaggtttgaaaaaatatattgcagatgtgtgaacatctggaggctaattgtacatgtttaggtactccataatctcatgaaaacttttgacctagaaatgtcagcgctgttgccctctcaaagagtcatgattctttatcacatcgctttattgtaaaatggaagtacatttagtggcaatatccgtgtgattagctatgtccagtcatcagatttttcttgcgttattatgattattacagattctattacactatgacattgagcataaatcaccagcctccttctcggcacatacaagagtcacttattttctaaaggttaccaaatatactaacttgtttaaacaaacgtacacacacaccttcctatatctgggtaggtacagactcagataaatcttcatacaacagcatgctataatgaaaagaacttaagttttagagtcataaataacttgatttgaatccatgagtatatatttacttactgtataatctagggcatgttatgtaaacacttgagaattcaatgccaaccttgggataacaaattttacccagcaagtctatgagaaagatcatagaaataacgcatgggaagtacttaaaacagtgtcctacacatggatacagatcaagaggtagtaaatacactcacaaaatggtctaattaagaaagtcttccatgagtttatgccctccaaaagatgagattcgaggccaattttgtgtcataaactttatgcttttataatattcatttctattttatgattatataatgcttaaataataatatagtaaatattcatgtaaaattcttacaccgaaagataaatattgttaatatgttggtggtcattaacttctccttctctctgttctttctcctctcttatttatgtgacaatatatgatccttttttctgaggtttaatagtgattcccatgttttcctcttccatagataccataaatctgttgatacacatgttctctttaccatgaaatagatcccttctctgtaccatggcccctataaatcaggatacactacattatgcatctataagaataattctgatatctcagcgactcaaaagaatagaattttcttcccgccaaacttcatgtcactatagattggtaggcgtctcaactcattgtactcagctgaaggacctgggctgagagaagggtcatctcaatataaactttaagaacgcaagagaacatgtgaaagcacacgataacccgtaaagcttctgcttggaaatggcgcacatcacttctgttcacatttaatttgatgaagtaagtcacatggccatatcaaagtacaagtaggcagagtaaaagatactatcaggagcctggaataaaagaatggaactttggtgaatagacttaatggcaaccacatcccttaaaacaagggttctcaaacttgaacatgcatcagaataacctagaggtttgttaaaacagggagtgttgggatccaccccctgagtttctcatcctgtaggtctagagtacagccagagcggttgcacttctcacaaattcccagttgctgttgattctgatgtctgagaaccacactatgagaactgctgccctaaagtataaaagctcttctcttaagattccacaatggaaaacacttcaacagtggtactttcgactgtccatggtcacatttcaaccacatacttctcaagtttccaaatttatctcaatctccaaccactggtctgttaataatttcccaaaattgctgtattatttcttttcctctggtggaatttaattaaaatatctttcctacaaaccttttccaaatcattctaactagaagtattgcctataccttttccatagtagtatacacctttccaaagtgatcacatgctttgtattatggtaatcttacacttgtgtttttctcagtttcatgaactgttttcaagcgcactcatagaaatttacccaaaatgaatactaaaacacttaattttttattcctgattttgccacattagggtaaaagacttggccacatgttctaaatttaaatcactactcttgtctcagaagccatgtgaacagtagggaggacagcataggttctggagctggactgcctgggtcaaaactaaccttgccactttttagctgtgtaaacttgtgcaaatttcttaagatccctgagccttttcctcatctagaaaatgaaagtgagaattgtattcataccataggactgttacaagaattaaatgaattagttgatttgaaacatttagtgcaggacttggcaagttttgagccattataaccattataattgcaaaacatcctgaagttattctctatgcctgaagttacattttcttaatatccattttctccttaatcccttaaaagctgtcttctgcctcatttattctatcaaaactgtattctcaacagtcactaattatattctaattgaatttcagagtgaatttcacacctctccttttgaaagattcatttctatgaatttgggacagcttcctagtatgatattccatctataagtatatccatatcatctatatcgtataccttatctgctctgctaactctttccttgtgttattatggatgttctccaattctgttctgcagacgggtgacaagtgaacatgtagaagaagttttcagtctcctagttttacctccattcaattaactttaaaatctacattactagttctgctgtgtcaccggcagtccaagaaaagaaacctgatcagtttgtgaaaatagctaatatttaatatgagcttattatgtgccagctactttacctggagtttcttatttaagccttacaattgctttattaagggctaggaacttcacatgtacattaaaatgtagaagcaaactgttgaggagagaaaggaatttacccatattatacagataactaataggaagtagagattggatttgaatgaatccaggactgatgtcgaagcccagtgtcttaatgttattttgggatgtctgcatagatttttttttctttataagggagtgatgattttaaaagcaacaagacccaccttaggtaaagtccatcatccaaaaccaaactcagttttattcctgtgcctacgcaaccacattattggatgcctagaaaatgttcaaacttctaaccaagtcactggtaaccctctgtgattttggcttaatcaggtttattcatcagttttgcccatatttcacttgagctctagtctcattaccttaattacagcttcctgtatgtctataggcttttgcttctatagacccaatttatatggtatcaactctatatgaagccgtttttgaatctcctagtaatgctttaattttcctaaaattcctgttatatcaaatcagatttcttttttatttttttgtcagttataagtttattttttgtgagggcaaaaataaatttgttggataatgagtttgtgagtagtagatcaatttgttcacatattttgcaaaagttagagcttattactcattcatgtactattgatgtaacgcattagaagacagttaacattagttcctaattgcacctgaccaaaaggagctgtgggcctggcctatacaccttattgcgtgttcagcatcaactgatttagtgaagcagcaaaaagaaaaatggtgtgtgcagtattatctttctgccacagatacatgtttttaatttccaagtttccaatgcatcattcagttttatctaatgggaatgcagctgagagaagtttgtatcaacccaaaactacatgctaatatagtttagttttcaagacttgtggagtctttttttttaatggaataagatcatcagaaatcctggagcaagacagactggctgtggtctaccagcattgtagtaaaaacattggggaagttttataagacctaattattagaaaataccataaaatagtcattttcatagaaaaagctttcctttctttcctcacactaaatcacattactttgtgttcaaggtaaaatggagtttgaaatctggatgtaaataagaaaagatattattttattccaagtgaaacatgtattcacacttcacgtcttgaagcaccaggtggccatttgggctgagttttcaagaaaaaaaaaattatatagattttatgtccccccccttttgttgttgctgttggtggtggtggtggtgatttttattttttggtaaagataataacatatgaaacaattttcctgttaattaaaacttactctatttatgagcatgatattttaaagaaattttttatatataatgaatatttggatatatatgtggttaatggttattttaacaaacattttggtttgctgaaatttttaagtttttttttcttttattattatactttaagctttagggtacatgtgcacattgtgcaggttagttacatacgtatacatgtgccatgctggtgcgctgcacccactaactcgtcatctagcattagataaatctcccagtgctatccctaccccctccccccaccccaccacagtccccagagtgtggtgttccccttcctgtgtccatgtgttctcattgttcaattcccacctatgagtgagaatatgtggtgtttggttttttgttcttgcgatagtttactgagaatgatgatttccaatttcatccatgtccctacaaaggacatgaactcatcattttttatggccgcatagcattccatggtgtatatgtgccacattttcttaatccactctatcattgttggacatttgggttggttccaagtctttgctatcgtgaataatgccgcaataaacatacgtgtgcatgtgtctttatagcagcatgatttatagtcctatgggtatatacccagtaacgggatggctgggtcaaatgcgatttctagttctagatccctgaggaatggccacactgacttccacaatggttgaactagtttacagtcccaccaacagtgaaaaagtgttcctatttctccacatcctctccagcacctgttgtttcctgactttttaatgatcgccattctaactggtgtgagatggtatctcattgtggttttgatttgcatttctctgatgcccagtgatgatgagcattttttcatgtgtcttttggctgcataaatgtcttcttttgagaattgtctgttcatgtccttcgcccactttttgatggggttgtttgttttttcttgtaaatttgtttgagttcattgtagattctggatattagccctttgtcagatgagtaggttgcaaaaattttctcccattttgtaggttgcctgttcactctgatggtagtttcttttgttgtgcagaagctctttagtttaacgagatcccatttgtcagttctggcttttgttgccattgcttttggtgttttagacatgaagtccttgcccatgcctatgtcctgaatggtaatgcctaggttttcttccagggtttttatggttttaggtctaacgtttaagtttttaatccatgttgaattgatttttgtataaggtgtgaggaagggatccagtttcagctttctacatatggctagccagttttcctagcaccatttattaaatagggaatcctttccccattgcttgtttttctcaggtttgtcaaagatcagatagtggtagatatgcggcgttatttctgagggctctgttctgttccattgatctatatctctgttttggtaccagtaccatgctgttttggttactgcagccttgtagtatagtttgaagtcaggtagtgtgatgcctccagctttgttcttttggcttaggagtgacttggtgatgcgggctcttttttggttccatatcaactttaaagtagttttttccaattctgtgaagaaaggcattggtagcttgatggggatgacattgaatctgtaaattaccttgggcagtatggccattttcacgatattgattcttcctacccatgagcatggaatgttcttccatttgtttgtatcctcttttatttcattgagcagtggtttgtagttctcctcgaagaggtccttcacatcccttgtaagttggattcctaggtattttattctctttgaagcaattgtgaatgggagttcactcatgatttggctctctgcttgtctgttgttggtgtataagaatgcttgtgatttttgtacattgattttgtatcctgagactttgctgaagttccctatcagcttaaggagattttaggctgagacagtggggttttctagatatacaatcatgtcatctgcaaacagggtcaatttgactttctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccgtcaatacctaatttactgagagtttttagcatgaagggttgttgaattttgtcaaaggccttttctgcatctatggagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcagtgttcatcaaggatattggtctaaaattctcttttttggttgtgtctctgccaggctttcgtatcaggatgatgctggcctcataaaatgagttagggaggattccctctttttctattgattggaatagtttcagaaggaatggtaccagttcctccttgtacctctggtcgaattcggctgtgaatccatctggtcctggactctttttggttggtaagctattgattattgccacaatttcagatcctgttattggtctattcagagattcaacttcttcctggtttagtcttgggagagtgtatgtgtgcaggaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcagtctatctattttgttgatcctttcaaaaaaccagctcctggattcattaattttttgaagggttttttgtgtctctatttccttcagttctgctctgattttagttatttcttgtcttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcattatgcaccccgtagtcattcaggaggaggttgttcagtttccatgtagttgagcggttttgagtgagattcttaattctgagttctagtttgattgcactgtggtctgagagatagtttgttataatttctgttcttctacatttgctgaggagagctttacttccaagtatgtggtcagttgtggaataggtgtggtgtggtgctgaaaagaatgtatattctgttgatttggggtggagagttctgtagatgtctattaggtccacttggtgcagagctgagttcaattcctgggtatccttgttggctttctgtctcgttgatctgtctaatgttgacagtggggtgttaaagtctcccattattaatgtgtgggagtctaagtctctttgtaggtcactcaggacttgctttatgaatctgggtgctcctttgttgggtgcatatatatttaggatagttagctcttcctgttgaattgattcctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagctcactgatgggtcttgactctttatccaagttgccagtctgtgtcttttagttggagcatttagcccatttacatttaaggttaatattgttatgtgtgaatttgatcctgtcattatgatgttagctggtgattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtagagtattttatttctcctttacttatgaagcttagtttgcctggatgtgaaattctgggttgaaaattcttttctttaagaatgttgaatattggcccccactctcttctggcttgtagggtgtctgccgagagatccgctgttagtgtgatgggcttccctttgagggtaacccgacctttctctctggctgcccttaacactttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaaattggttccattctccccatcactttcaggtacaccaatcagacgtagatttggtcttttcacatagtcccatatttcttggaggctttgctcatttctttttattctttttcctctaaacttcccttctcggttcatttcattaatttcatcttccatcactgataccctttcttccagttgatcgcatcggctcctgaggcttctgcattcttcacgtacttctctagccttggttttcagctccatcagctcctttaagcacttctctgtaatggttattctacttatacattcttctaaatgtttttcaaagttttcaacttctttgcctttggtttgaatgtcctcccgtagctcagagtaatttgatcgtctgaagccttcttctctcagctcgtcaaagtcatcctctctccagctttgttccgttgctagtgaggaactgtgttcctttggaggaggagaggtgctctgctttttagagtttccagtttttctgctctgtttcttccccatctttgtggttttatctacttttggactttgatgatggtgacgtccagatgggttttttgtgtggatgtcctttctgtttgttagttttccttctaacagacaggaccctcagctgcaggtctgttggagtaccctgccgtgtgaggtgtcagtatgccccttttggggagtgcctcccagttagggtgctcgggggtcaggggtcaggcacccacttgaggaggcagtctgccccttctcagatctccagctgcgtactgggagaaccactgctctcttcaaagctgtcagacagggatatttaaatctgcagaggttactgctgtctttttgtttgtctgtgccctgccctcagaggtggagcctacagaggcaggcaggcctccttgagttgtggtgggctccacccagttcaagcttcccagctgctttgtttacctaatcaagcctaggcaatggcgggtgcccctcccccagccttgctgccaccttgcagtttgatctcagactgctgtgctagcaatcagcgagattccgttggggtaggaccctccgagccagatgcaggatataatctcctggtgtgccgttttttaagcccgtcggaaacacgcagtattcgggtgggtgtgacccgattttccaggtgctgtccgtcacccctttctttgactaggaaagggaactccctgaccccttgcacttcccgagtgaggcaatgcctcaccctgcttcgggtcgcgcacggtgcacgcacccactgagctgcgcccactgtctggcactccctagtgagatgaacctggtacctcagatggaaatgcagaaatcacccgtcttctgcgtcgctcactctgggagctgtagaccggagctgttcctattcggccatcttggctcctcctctcaaatcagatttctgatccaatatttcaagttttaattttcccactggtaggctctattcctactctttttctgctcatggctgaaaattttctgtatctcccatctctttcatatttgaatctattgaatacatagcctccacactcttaataaaatactaatttcatcatgtaacttcattattcaaaatatttagtggctcccactacctatattaaagattccaaactcagtagttactaatatttttcataggctttctagtcctgtcctttcttttagtcttatctcttactactttaagcttattcctagggcaaacatcttactatttccaaaatgtgattcaacgtcattcctattgcctaggaagacactcttctgtcctatggctctctaagtctacttcctgttgaagtactctttttcataaacattcaaattgtttttgtgtcctactttggtgttacctgacatattttaaaactcatggattggatcacatatctatgcatttacttatggcaccattacattttatttattttaagagacaagatattactcttttgcccaggctggagtgcactagcacagtcgtagcttaccacaggcctccaactcctgagtcaagtgatccttctagctcagcctcctgagtaactagaattgcaggtgtacaacacaatgcagaggtacatttaaacaattttttattgttattttgtagagacagggtcttgcttcattgccccggttggtctcaaactcctggcctcaagcgatcctcctgcctcagcctccgaaaatgctgagattaggaatgtgaaccattgtgcctggcccacgttacattttaacagtggggatctgaacactgcagtttcccaaagccaaaaacatgactaactcagctataaatatttaaccaactcttaagtatacctcctggaccatggtcatatagagcagaggctgtgctactatatatgctttagttttgctagtacatttagaaaattgtttattacatagtcagtactatggtgaatggttaagatatgttgaatgccctgctgagacaacgtttttactttgataggaaagtcaaaagaataacacacatatttaattattaaagaaccagaacatgtagttttctgaatttcttagtataaaaagctccttaagagacataagtatacaaatatacacttcttcatctatgatactctattaaatttggcatatttctttttaacaaaaacttacaagggtagaaatctgctgagatgatatatgaaatgtggaaatgttaaagatagattgggggggtggttaagataagacattgaagcatataatactcctcttggagaatcattcagcttgccaagctaccatgaatcagtgtttgaaaagaggcagaagatacatacatagaaaaatcagccaaaatattcattaacatgaaatgtttccaaagctgaagtgctacattaatggttgactttgtgcctcaagactaaatattgggcaatgttagctttccctataataaaacttgccccaaaatatatgttgagtatcccttatccaaaatgcttgggaccagaagtgttttggattttggatattttcagtttggaatatctttattatacatacgagttgagcatccataatctgaaaatctgaaatccgaaatgattcaataaggatttcccttaaaaatgatcgtgtagttactcaaaaaattacagattttgtagcatttcagatttcaaattttcctattagggatgttcaacctgtattgaacttacttgcttacacgtgttgcccgtttgctgtactgtaagctctgtgaaaaaagtatctgctgacttctttgttcataattgcgccctagcaccttttgtggtagttggaaaatggtagacactgagtaaatatttactaaatgagtggataggtaaaagtatttcagtttggcatggcaagatggaaagactaacagtgtttaagtggctatggccaacgtcaggccttcttcagtttaagaactgtggaaagaagaaaattaaacaattaaggaaagataagaataaatccaacaggaagttctcactgaagccaagagattcaaaaaaatacaggaagaagaagaggaagaaaatactattttctatgcattatattcccaaagatatctgccttactgattaatatcaattaataccataactatcacattttctcataggccaaggtgaaatgtctgataagacaagctttgttgctaacacaatttaactcactttagaatattaacatgacatttatgtggtctactcctctctaagctcaaataaagcagctgcgtataaaaagcagccatggattaaatgacttcagcctgctttgtggaaactactgctgttaaacctgctcttgataaactacaaagagtgcctggactccatttatgaaaagacatttgaatatagacctcacatggtgatcatttaaaaatattatattttgcctgtattacaacattgggttgtatttttgtttaaatctctacttcatttacttatgcgtgtaatactgacttgcttcacaaaatgttactctggagtgtctggcaagcttcctaacaagaaatttgaaagcagttttacatgaaaatcacatttttgaattttatatttctagacaagttttagtacaagcagtgtaagagcataagagtagtctatgtcatatgctatttgtcagtctccaatgaagagtaaacatttatcagcttcagtaacaatccctgcctaactgaggagtgtcattttctgaaaatattgattgatagaggccttgcctaaaaaatataaaatgcatgtaatttacacacagctgagaaatacaagctcattttttcctgacaagcagtaatgccctttataaactatggagattaaattacaaaaaaagttaaattaaaaacaaaagtatgatcagagtgatcagagttttgtgtggtacattttctagtaatcatgttttacagcagtctaatttggtaaataaaagtgaattggaatatattttaaaggctaatatgtatatgtgtgtatgtgtatgtatatacatgtatatgtgtgtatatatacatcatagaaacctttatatttaagagaaaatcatcaacaaatacttttaacacatttgttgttatgacgcagtaacatgtatcctaaattaggaaagtcatgtttccggatattttcctaaggaaatattggttctaaaaattcagcataggaacgtcaagtattttattattcactgaagggaccaataatatcaatgcaagcagaggcctgatatagaaaaattaattaaggtgattatagaggtgtaagcaggactctagtaaatgaatttagaaggtggtctagtcagttgcttgaacattaatcagaatttagagttctgctctgttataaactcaatggtctcgtgaaaccatttttatacaagtctcaatgaattcatctctatatagttcttgttccacctactttagtattttttgaggagcaaatgagataatgtgtgcgaacataagacacaatgtgtaatctaagccaatctgggcagattaccttctctagtgcagattagagatatctatgcattcactaactgaatttttgtaccagttggaagtgtttctgaagcagatcttttttttgctagtctattataattattaaagatgatatcatgcctaaaatttgtcacattaaagaagcatcagtatctttgtaacattcacacattgattttacttcaacctagaggaaccatgactgcctttaaccatttgaaaaggtctttatgaatctaccatctccaagatgaatacccacagcctttattattgggctcacttttggtgtcctttatcgtcatggtagtcatagctcctacatctagtaaacgttaggcctagaatttgaattgccttgattctcaaataatatctgaatccatcatcttatatatttataatttctttgaatatgtgataattaattcagggtaattagcacatccaatgtctgtgtgtagaaacattgtgttggaccccataaatatgtataattatcatgtcagtcataaataataaaaaaaacttcccacaaataatttataaacccatgcagtccttataactgctctttccaatattaatttcagacttaaaggtgatctgttaaattttatcttactggtttcgatattattatagctaagacatccatagctgaattttattacaaagagtaaaagctaccctttccaggagagtaaaatattttattataatagctgtatttttatgccttaagatccaagatcattggcaaggtatatttggtggaagcagtccaaatgagagtcacatgaccatcaagtagatataactttaaactgacacaaggccatttgccatcactttttggatagggtgtgctgccacatgtgtgtttttaaaatactatattttagtacagattcaaaattttgtctgtgaatttattatgggagacattgataagctacattgtgaatatgaccttatctatcgaactaataatatgatcaaaagagaaaatgacatttgttcatgggttgatttgctaaccccgcagtgtcataaatagtttatagtagtgtcattgcctccatagaaagttaagattgcgtagattcttcagctgtaataaatttgtaacatatatattggataaaagtatatgagaatgttcaaaacattatttagattaagagatatacctattagaaattgcatatattccaggggaattttttaaatttttgtgggtacatagtttgtatgtgtatatatgtatagaaagagagagacagtacatgagatactttgataaaggcatgcagtaaataataatcacatggagaatggggtatccatccactcaagcatttatcctttgtgttataaacaatccaatgatactgagttattataaaatgtacagttaaattattgagtatagtcaccttgctgtgctcgcaaatactatgttttattctttctaaggaatttttgtacccattaaccaaccccagcttacctccaccccctagtaccctactcagcctttgagttgagatctctctctctctttagctctaataatatttgctttatttatctgggtgctccagtgttgggtgcctaaatatttgcaattgttgtatccttttgctgaattgacccctttctcattatataatgaccttttttgactctttgtttttgtcttgaaatctgttctgtctgaaaaaagtacagccactcctgctgttttttggtttccattggcatggaatatcttttttcatccattttcagcccatgtgtatctttataggcggtcattaaagatgtcaagtattttgtagaatcatagcatgtatataaacacatgcatgcatatacatatatatacctatggactacaatattatagataaaatttcataagtgactatgatccatgatatgagaggcagagaatgctcagcagtgggatccctctctcaagccatactgtcaaatctagtatattgaaatttctggaacacccttatatattagagtctttaccagaaatgctggtacgtttattttaactgttattgcagaaatggctaagaaaacaatgtctagattctaaagcaaggattaggattgtatactttcttctgttgtgttacacagatacaaccaaacaatgactatttattaagtactatctgtggctaaggtgttgtacttgaggctgtgttatttacgcactaagctgttaaagtttatttgatgtttactagagctttctgatgccaagaacacaactctggttttggtagctctcttttttccattgtttaaaaatgctaaagatcatgcaaataattaacatatgataaacattttttaatctcagtaacattgtaaatttataatatgatgagaaaaagagctgaaagattactgatgtaatttataacaggttagtatttttagttcatcattataaacccagaagagaagagctaataaagttattcagttgtgcttatgtaaatcttttggatcttgagacttatttaatgactggatgaagattttaagtgccatgggatatgtgagctacatggttcaactgtacaattggatcactgttcattttatgggctgtgatatacttcacattgggttgatttattgtttcagagtaaaattagctttaacatgttttcttcctaactgaattgtaaatcaattatgttaacagctcctcttggtaagggcctagacaaaatacatatggtcaataaccattttgtgtgaaataagcatataaaaagcagactttagtagactactctagatttgcatagttcctcataaatcaactttatgaaaatgataagaactgaacagaaatttatttgaagaatttgagccataacagccttataaattaggttcacttcacctattttattcacctcgtttagtttcagcaaaaaagtctgatttaatttagagtttattattacttttgattttaaatgcacaattcttaattgtatatttatacattccagttggaccaattttttgaaaggatttcctcaagaagtagaattgcaccatttaaatgtattatatttgacttgtcaactgtcgaatctaattgtcatcatttgaaatacaacaatatgtgctaattattttagttttagtttttattcttttactggatgtacttaaggcaaccttgtccaactcacagcccatgggctacatgtggcccaggacagctttgaatgcagcctaactgtaattcacccactttcttaaaacattatgagatttttttgcaggtttttttttttagttgattagctattgttagtgttagtgtattttaggtgtggcctaagataattattcttcaaatggagcctaaggaagccaaaagattacatacccctgatttaaggggtacaagatgttacgatatacatagacataatgaaatgattactgaattcaaccaaattatcctatccattatcttccataataactgttttggtatggtaagaatacctaaagtctcttttcttagctaatgttcagtgtacaatacaatgccattaactgtagtcatcatactaagcagttatcgagatttatttatccaatataacttcaagtttgtgtcctttgacctacttctcctcatttcttccaaacatttaaagagtaatttataccatttgttcttaaaatcttctaaataatagaagaggaaatacctccaaagccatttatgacttcagcatcaccctaaatacgaaagtcaaacagacaccgcaagagaagaaaatatatatatgccaatatctaggaggaatatagatgtgaaagtcctcaataaagtattagcaagacaaataacacattggattataaaccgtgaccaggtgggtttagccctaggacacaaggttggtttaacatacacaaatcaatcaatgcgacatactacattaacagaaagatgaaaaaccacatgattatctcaatacatgcagaaaaagcatttgataaagctaaacatccttttattattataactcttcgcaaaatatgtatggaaggaaatttcctcaacatcaaggctatttatgaaaagcctatagctaatatgatcaacggtggttgtggggtggttgtactgaaagctttccccttaagatttgctaaaaagcaaggatgcccactcttaccacttccatttgtcatagtaccaaaaatactagcaggagcagtgagacaaaattaataaaaggctttcacatctgaaaggaagaagtaatattatttctgtttgcaaatggtatgatcgtatatgtagaaacccctaaggactccacaagaaaaatgttagaactaataaatgagttcagtaagtagtggaatacaaaatcaacataaaattagttgcatttttatgcaaaagatatccaaaaaattttaaaaaattctatttatgataacatagaataaaatatttaagacccaatttaaagaagaaagtgaaaaatacgtacaaccaaaactataaaacattgaggaacaaattaaaaggtaaatatatgggaaaatatcccatgtttgtagactggaagaagtaatattgttaaaatttccatactacccaaatggatatatagctgtcccttggtatccacgggacatgggttccaggatgccagtggataccaaaatccaaagatgcttaaatcccttatacaaaatggcatagtatttgcatatacctatgcacacccccctatatactttaaaacatctatcgattatttgttattacacctaatacaatgtaaatgctatagaaatagttgttaccatatattatttttacttgtattaatattttttgttgttgtattgagttttttgttctatttttgattatttctggtctacagttgcatccgtggaaatagaaggttgactgtacaaatttaatgtaatccctgtgaaaatctaaatggcattttttttcacagaaataaaagagcattataaaacttacatgaaatcccaaatagccagaacaatcttgaggaaaaaaaagttggaaatactgctctttggatttgaaattatatcataaatctacagtattaaaaagagtattgtaatgccataaaaacagacacataaactgatggaacagaatagagatctcacaaataaacctaagcctatataatcaactaattttggacaggaccaccaagaagatatgtggggaaaggacagtctcttcaataaatggtgttgtaaattgtacccttgtcttatactgtacacaaaaattaagtgaaaatggactaaagacttaaatataagacctaaaatcataagactcctagaagaaaacagagaggaaaaagctctctgacagtcgcctttgcaaggattttttgaatatcacatcaaaatttcaggcaagaaaacaaaaataaactagtggaactacattaatctaaaaagcttctggaaagcaaaagaaaaacacagcctacagattatgagtagatatttgcaaaacatatatctgataagggtttaatatccaaaatatataaggaacttgcacaattccatagtgacaaactaaataacccaattaaaaaattgggaaagaacttgaacattttttttttcaaagaagatgtgcaaacggccaacagggaaattaaaacgtgctcaatatcactattagggaaatgcaaatcaaaatcataataaggtattacttcatacctgttaggatgagtattatctaaaagatgagataacaagtgccagtaaaggcaaggaggaaagggaaccctgacatactgctggtgtcggtgtaaattagagcagacattatggaaaattgtctgggagtgtttcctcaaaaagttaaaaatagaactaccatatgacccaacaatcccactcctgggtatagacccacagaaaatgaaatcagaaccttgtggagatagccttactctcatgttcattgcgttatgattcataatagccaagatatgaaaataacctgagtgtccactgacagataaagaaattgtgacacacacacacacacacacaaatattcagcctcacaaaagatagtgccatttgtaacaacataggtgagcctgaaggaaattacactaagtgaaataagcaagacacagaaaaaaatatgctacgttatctaacatctgaaatctgaagaaaatgtataagttgaatacatagacagtagaatggtgattaccaggagtagtgagggtgaggaaataagtcaatgtgtacatggaaacttgcagttatgtgggataaataaatttagagtttcgatatacagctaacccttttttaaaaaaatataaaagcagataataatggggtaaaatgtagtgttttgatctatgcatacattatgagaaagatttgatctagctagttaaaatgtctatcgcctcagctacttaaccctttctaatatttatctaaaatatgtcagatccagagatgtatgaccagattttaacatcatttttaatgtagaattgacagttgtaacaatgattttctcagtttgcttattcaacacccatggaccaagataataaatttaggacctatttaagtagtttctaaaaaggcgttaaaaaaatccccatgggggcaaacaatgtgaatcgaataacatttccaaatgaatgtaatttgctcatttggatgtgagctaagtaaaaaaacgattgtaaaagaaaatgtaagtaatagaaattatctaagaagagcaatgagatgtgttccatctgtgaccaattttggtcaattttttcacaggcatttaatgggtgcaaaatgagccagtcttggtattagaccgttaaaatgcattgtcttctaggagttcatattgtttcccctcccattctgaaaaaaattagaaaaggtaacaacaataaagaattgtggtagacaaaaactcttttgtaaggtatgatttgactcgtataataggtgttacgagtgttgagtggctctgtcagatagaaacagtcaaagaaatgctagtaatgttgtcttgtttgctttacttgtaagtatcttgtgtattttatttacttaatatatttaatttactttaatattaaaacgtgtgtgtgtgtatatatatatatatatatgaatgaatgaattctaatgggtcaggtcatatagtatgtgtgtgcacgtgtgcacatgcaagctgggataacaacgtattatatgatagagtctatctggtgataaacgttcagaggttggaaaagggcattgtgtaccaagctcttgaggtattctgggaaataactgcacaccaagcatttggatattgactgactgataacagtaaatgtacatttattcagctaaataaatgaaaaaaaaagtatcaggcattccaagcagtgaaaataacttaaataagaacacaaaagtaagtctacatttaatatgctcaaagcatcatgtgcatctgtacaatatccaaaatatttccaccagaattaaattttgttattccattattttactataatatttggaggcaaatgcatattaacataatcagtttaaactttgcaatactaaggtttctcttttatttagtacaatgacccaaagttatagaattatttgcctctgatttcttggcaacatatgtatactttactgaaaatttcatctacttcattcttcatcaccctacactcacacagagaaacaaattgataatgagaaattgaaaaggaatatgaaagctcagtgctgatttttatttggttcatgtaaacctctagaagcttagctctattaagattatctgaacctttgtaatactttctatttgaagctatttgcttccaaccagtctatcttatattaattattattttcaattcatcagattatgtggatgcaatggctgataagttgagatatactttgaggaacactgctatgataatcatgatagaggatgcatgggtgattcatagtatttccaactatgtccagttatgtttagtgtttgtgaatcacctatttgcctaccttctctagttgagtaactatatatgtaggtaattgaatcagactattttgctaccaagaatatagcctcttccccgatataaagaggcaccaattacagattatttacctaatggagcattttaaatatggaaggttattaactatttacacttgagtcaacattggaataaaaagttttagctgacaaaattatttgctaagtgtgtacttccatccacatttgccatatattttaaagagcaataaggaaagtcttttaaagtgatgaaattcagggctttcatttaattgatgtttttatgtgacatatttatattaataataaaatgcaaaacagtgaacaggtaatatttaatctttgttcttccttttcttaaagtcaggaagccagaactagtcagtcctatcagtaaaagcaaaagtaatatatccaatgacatttgcttaaatacattaccaagtcctgagaaaggttcttactaatctgggaataaatgtccttatcttgatatgtgtattagtccgttctcacattgctataaacaactacctgtgactgggtaatttataaagaaaagaggcttaattgacttgcagttccacaggctgtatgggaagcatggctggggaggtctcaggaaatcactgtggaaggtgaaggggaagtaggcacggcttacatggccagagaaggaggaagagagagcaggcagagatgctacacgctttcacacaaccagatatcatgagaactcactatcattggaacagtaagagggaaatctgcccctatgattcagtcacctcccaccaggcgcctcattcaatattggggatcacaatacaacatgagatttgggcagggacacagtgccaaactatatcgttctgccccaacccctcccaaatctcatattgttctcacatttcaaaatacaatcatgctttcccaacagttccccaaagtcttaactcattccagtattagttcaaaagtccacagtccaaagtctcatctgagactaaggcaagtcccttcaacctatgatcctgtaaaatcaaaatgagttacttccaagatacaatgagggtacaggcattagctcaaaagagttaaatcgatcagaagaaaggggttacaggccctgtgcaagtccaaaacccagcagggtagtcattaaatcttaaagctccaaaataatttcctttgactccacatctcatccaagccacagtgatgcaagggacaggctcccaaggccttgggcatctccatccctgtggctcagcagggtgtacagcacccttagttgttttcatgggctggcattgagtgactggggcttttccaggtgtatggtgcaaactgtcactggagagaccattctaggctctggaggacagtggccctcttctcaaagctcaagtaggcagtgccccagtggggactctgtgtgagagctctaaccccacattacccttctgcactgccctagtagaggttctctatgcaggctcccccgctgcagcagacttctacctggacatgcaggtgtttccacacattctctgaaatctaggtggatgctctcaagcctcaactctcacactctgcacacttgcaggattaacaccacatggaagccaccaatgcttatggcttgcaccctctgaagcaacaccccaagacacatctggggcctttttagtaacagctggagctggagtgtctgggacatagggagcagtgtcttgaggttgtgcagagcagtgaggccctaggcctggcctccgaaatcatttttccttcctagacctccagacctgtgataggaggggctgctgcaaagggttctgaaatgcctttgggcattttcccctttgtcttggttattaacattcagttcctttttacttatgcaaatttccgcagacagcttgaatttcccccaccaccccgagaaaataggcttttgttttctaccacatggtcaggctgcaaattttctaaacttttatgctctgcttcccttttaaatataagttccagtttcagataatctctttgctcatacatatgaccgtatactgttagaagaagccaggtcacatcttaaatgttttgctggttagaaatttcttctaccatataccctaaatcatcagtctcaagttaaaagttccacacatacctagagcaggggcacaatgctgccaatctctttttgttaaagcattgcgagagtgacctttattgcagttcccaataagttcctcatcttcatctgagaccacctcagcctggatctcattgtccatatcaatatcagcattttggtccaagcagttcaagtctctaggaagttacaaactttccctcatcttcctgtcttctgagcgctccacactgttccaacgtgtgcttcttactctgttccaaagttagttccacgttctcatgtatcttcgtagcagtgccctacctctcggtaccaattttctgtattagtcctttctcgcattgctataaactacctgagattgagtaatttgtaaagataagaggtttacttaactcaaagttcttcaggctgtacaggaagtatggctggggatacctcaggaaatttccaccttcttgtggaaggcgaaggggaagcaggcacatcttataccttacatggccagagaaggaggagaaagcagggggcagtactacacacttttaaacaaccagatctcatgagaactcattatcatgagaacagcaactgggaaattcaccctcatgatcctatcatctcccaccaggcccctcctccaacactggggaacacaactcaacatgagatttgggcaaggaaacaaatccaaatcatatcaatatgctagaatgactcaaacaataaatacgacaagaatattcctcctctgtattgacgctgttcagtatttttctggagaacctagccaatattatatgacgagagaaagttacatgaaatatatattggaaagcacaagataaattatttgaaaataatatgattttctcattatgtaaaatgatctcaaaattaggaaatgtacagtggtaataaaatgatactcagcatagttactttttgtttttcagtttccacaaacaagtgagatcatgcaatatttttctttctgtgtcttgcttatttcacttagcctaatgttcttcggctccatctgtcctgtggcaaataagaagatctcctttttttgtgtttctgttttgagatgaagtctcactctgccactcaagctggagtgcagtggctcactgcaacctccacctccccggttcaagtgattatcctacctcagcctcccaagtagctgggatttacaggcgcccaccaccacacccagctaatttttgcatttttagtagagatggggtttcaccatgttggccagggtctcaaactcctgacctcaggtgatctgcgtatctgcctgccatggcctccctaagtccctaagtgctaggattataggcataagccaccacacctggtcaagatctccttttttttttttttttttttttttttgatggaatctctgtcaccaggctgatgtgcagtggcacaatctcggctcactgcaacctccacttcctggctttaagagattctcctgcctcagcctcctgaatagctgggattacaggcgcacaccaccaagccaaactaatttttgaatttttagtagtgattggcttttaccatgttggccaggatggtctcaatctcttgaccttgtgatcctcctgccttggcctcccaaagtgctgggattacaggcatgagccaccacgcctggcccaagatctcctttttaaaggccaagtaatattccattgtgtataactatatagagagaataaaacagtggttaccaggttgggggtggaaggaggaaatggggagatgtaggtcaaagtctataaagtagcaaatatgtgggataaacaagttgaaagatctaatataaaacatgaggattatagttaatagtgtgttgtattcagaatttttactaaatgagtagattatagcttctcgtggtcagagggtgggggaacgattatgtgagatgatggatatgttaatttctttcattatggtttcattatggtaaccatttacatgtgtatcttatagcatcatgtgtataccttaaaacacacaataaaattatttttaaaaaagagaagttccaaaatctatgtagttttcttagaagtaaaccgcacaagaaagtataagcttttttttataggaagtttaaagttgtatataagtacataaataaagacatgaggaaaggaagtcacatatgatgaaaatgctagttctccctaagttagtttgtacattgaaagtaacttcagtcacactcgcatgttcactggagcactatgcgtaatagcaaaatcgtggaatcaagttgtgtccatgagtagataaagataatgtggtgtgtatatataatggaatactaacgagccacaaaggaataaaattatgtcttttgcagcaacatggatgaaactggaggctatcatcctaagtgaaataagtcagaaacagaaaatcaaatactgtattttcctataagtggtaactaatcaatgggtacacatggacatacagaattgaatactcaacattggagactccaaaagatgggagagtgggaagggggtgagagatgaaaaattacctattaggtacattgtagactatttgtgtgatgggtacactaaaagccgagacttgatcactacacaacatatccatgtaacaaaattgcacttgtaccccttaaatctaaagttcctgaagttacttcaatcaagatctagatggtccctgacttaagatggtttgactaatgatttttcaactttatgatggtgtgaaagcagtgtgcgttcagtagaaaccgtactttgagtacccatttaatcatgccatttttcactgtcactactgtgctcaatgcattacacgatatattcagtactttagtttttatagaacaggctttgtgttagatggttttgccaaagtataggctaatgtaagtgttcttgcatgtttaaggaaggctaggctaagctataatatttgacaggttcagtgtattaaatgcaattttgactcactatattttctatggacaatgggtttattggaatgtaaccctgtcataagtcgaggagcatctgtataattacacactcacatgcccacaaacatgtatgtatgcgactctctgtgtatctatatttgtattattttagaggatataacagaaccctagcaataaatagaatttatctcagatggtaaaatgaagataattgtattttaaaagttacagaagtatatattaacaaataggtgacaagaaataatctagagaggagcaatagtaggaagtagttactatttctactattcctactatatagtagctgaaaggaaagggggaacggagttcagtgaaagctgcaccaatggagggaatgtagttgttggtagaactcagatactacattatgcagctctggagcagggaaataatagagaaatttccccagctttctctttccctcttctttcaatctccagctggtacttcccaccagcttaatgcaactggaatctagccagctaatgatcacaggagatacagtgtgaaagggtcagccacttagagaataagcagagaagaaagggtgtttatgttcagggtgagcacactgaacataaatcacatgaatggtaagagggattcagttttctagataattctaaaatttgtttaaatgtaaatgcgtgagtacagttaagaaattattttcaaacaggtgatttgctttagtagattttataacatacttaacatagtatgacatgatagagaaataatttaatggtgtggaatagatattttgacaacattcccttttatttaggtaaatttagtacacaattagggtgacatttcatgtctctagagatagaataggttagctaataaagccttcaactgtggaaacccaaggcacaacaaatactaagataactttcagataatgattgaatgtgaataaacatttaaatactttattacaatgtagaagaatattacaataatattaaggtgatataaaacctagaggctgtaaaataccgacaaatttaccaacacaaaattaaaatattttccattgtgaaagaccattaaacagtaataaaacctatgatggactgcagaatgacactagtaataaaaaatcaataacctcagtatgataacactcctacaatgaatatacaaagtataatattttaaaagtggctacatattatggtcaggacattcacttgggaaaattagaaatagcccatcaaaataaaattaagcttaactaataaataaatgcatagtacaaatatcttcttattatgagggttcatgtaaataggccctgtgtttcttttggaggaaacacaacttgtaatattttaatcagacaatttagtattatctttcaaaatatgtaattttacatatatttgatcctgaggtttcacatttaagaattagatatatagtaatactcatacatatctacgacaaatgtgtaaggatgttcattgcagcgttgtacacagtagctccagtatttttcatgctatggactgttaggcagatatatctctaccattggactataggcaccataaaatcagggtctaggtttgtttgtgtttgtttttatttttgctcactatttcagctgcagtgtccagcataatcctcgacttatggcaagtgtccaataaatagttacagaataaataaatggataaatgaatacatgcattactgaaattaattttgaagttcacattgtatatatacatgtgtatatacattttaaacttgaaatttgctgaaaacatactttatgccaggcattgctctaaatgccttacttgcacttaccttcttggaaaagtctttgcctcattttaccaatgagggtatgaagaaatgaagaaattaagtttcttatccaaattcataataccagtgagtggtaaagctaaattttgaatctttactaattgagcacatcttaagaaagtacatgcatagacagtgtatatgtttaatctcattagacaggcagatgagtatgataaatggatagctaaaagaatggctgaatggatagatgcatggatgtatggatgacatagcatctggtgacaagtattacttctagctaatgggactgtggtgctgtagagatatggggtactttcactattaactttaaatgcgtctgtactgttttagttttccactacaataagcatgtatggcttttgtaataaaatgtttaaaagtgagagattaaatccagacttatgaaattaaaatatcaaagacaactaacggttgaactcttggggccaaaaccgtcaatgggatgtgttttctctgagggaaagctttcctaatcaaggggcacgttcccattgagataagagtggaaatgacccatctggtcaatccaagatcagagcccatatggggactggagctatgataaggagtcaggctccataggatatagtaattgagatagttataccaagcccctgggtttctggtcatcaggaaagacaggcccctgctagtagagctctacctgagggagaggtatttgagagaggccgacatttcagagtcaagaagaactggaagctataccaagaaaatgggttatgtggtatttagcatatcagttttaaccctcatccagccactgagaaaaggaaagaagaaattttaaaattgcaaatggacaaaaggaacattcagtaattaaaatagcagtaagattctacgcaaagcctttccttttctctatttagtctttgaagttgctaatatctagtcaaagggagttgctttccaaatatgtaatgtttgcatgcatattatagttatatattagtgatcatattgtttataaatgtgtgtataccatcctaggtttttgtttctttattgaatccctttctcatatatctgagcttaaaaagcattttttacaattatcattatttggtagaatcctacccaccgctgactcatagttttagtgagatgacaaggaattcacacacttgaatctttcaaacccccaggtatgcagacgcttagcacaaaatttttggaagctatgcttccaaagttctaaggagtctgcttttcctatcctcagtctgagagcacttgagtacatttttttttctgtagatatcagtcaatattatttttgaaaatacgtttttgtaaagcacggtgctattttgtagtgtgtatgccaaagtttagaacaatgaataaaacattagttttcctgtgtcttgagtattttcaatctgaatttaaaatgtactaactttgtcatcatcactcataggcttcttgattaacctgctaatgctctctaatttggaaattaatgcttctttccctatcacttaaaaataatctgatacagtttctagagcatgagatgttcttcaaatcaagtcttatttttggaaatgtgatcaataagaaaaacttcttgcaatacaataggaagctgaggtgcattatgcttaactttatccaaggtcacaaaatgaaagaactgggagccaaaccaaggactctacttttttttttccactttaatcagactgtcacttattggttgtatgaccttgggctgtattcttaactcacaagagagtggtgaatttaaatgaaaaaaaaacataataaaagttcttgtatataattgatacttgataaaaactaattctataccaaactgaatctcttttgcagaattttgtagggagaaaaatacaggctgctcctgttccttgctatgtgctttctgccccttcaagcagtgctcaattttcaacatgtgtcttactctacattcagggggtgtagaccatgaaaatgaacctttattcccaaaaggttctctctccattcatttactgatttaacaaatactgagtacctactacttctcagtcattggtaaaacaatctaaaggaagttcctgcctttgtggtttttatattcttatataaaaaataaacataataatgacagtttgtgacaagcaatgtaaaggaaatcaatgtaaaataaagggaaaggggttgggcttctttaaatgggataggaaatgcatctctgaagaggtgccatatgagttaagacctaatgggtgagaatgaatcaaaaatgcaaaaagagaaattattttaggtaaaagagcaccaaatatgaagatcaagaggtgtaaaatggccttcggtatttgagatgcaaaaacaaaacaagaccaatgtgtgaaagagaaagagggatgacattagagtgcttttagctaagtgtgaaggattgggtcatgctgtactttacaggcatggaaggcagtgtcttttaacacatacatcaaattctattcactattcaaaaaatatactttagtatatacattttaatgaaaatcaatctcagctatgttttacgcattcttaacatcatttattacattctcttttataaagttatcccttatcatcatcatatttgtgttacatggttttggatgcttactctctttttcacttgtacctttctccatcaatgcttcacatttgattatcttcacttctgtaaatttctaaattgcatttttttcacattggaaattacttgacatccatggatattattgtatttgtagttgggaggtcctaattacaatggtggaagccagaaactccaaactcaaatgaaatttcataagtactgtcaaaaggaaaatgtatctttgtaatttgaaaatgggttaaagtttgctacttcttgattgggtgtgtttcatcagcatgcctccagtagtgcttagaaaatacacaaatgcgtgatgttcgtccactggtttcagttttcagttagagtactactgaaaactttggattagttcaggaaaacttaattcgccatcagttattttgtcagttgttgaagtttgtgtgtgatggtgttttgctcaacactgaaccccttattctgatgttgcgtatgacatatgataccaccatgacaccatcccacataaatgttttgtgctgagagagtcacatcagtgttgtatgccatctggtttgtccaatggtccactcgtttcttccttaggaattaggaaatggagccattctaattataaaacgtgattaattgcttggtgaattggtatcatgtctgacacatggtaggcattccacaaatacttaatgaaggcatgaatgcaagcaaacctatgaattacaattatgtgccaattggaaggaaatcaggaaaaataatagatcgtatatattgagcatttactttgcattcattttctctgttaacatcatccctaattatttgcaagatactaatatgactcattttatagataaaaactgggacagggaaattagtgaattttaccacagtcccttacctattagtgatagggtcaggatttgatcaaggtatttttgcctcaacaggctaagctcttttatatgtagtgggtccatttttaccatatttttttcaaaaaaaaaaaaacctgatcattttgtacaatatctgcgttaagctagtcatcattgagtaatttgccccaggactgcccttataccatcaggcatattttgaaatcccaaaatataccagaaagaataataaccaattaaatttatgtcacatgaaataaacatctttattctggcctcactgtgtatcaagtataacttctaacactgtaaacaattaaggttcacaaatagactattttatgttagcgaggaagataaggggtggagttacttctgaaactgactatactttttctagcagcagaggaaagaaaaagtcaatttggttaggtcaaaagcaaagcacgaaaaccgcaggtgacaatcacttaagcagagttaaatgtcactgagtcaaaatactttcatctcaaatgtaaaccctaatagttcttcccacaacaggcatgtcgagagaattgtaagaaagtacagatgtttttctatctgtagtctcccatgctgactgagtagcttccatttgttatgtcaagttagtgtctgttctcctgggtttagaagttacataccaaatatttgttctaaggatttaaatagtcaaggatgtatttttcaaataaaatatatttaacatatgtaaacttaggacaattgtgacggaagagacaattttgaaaatttcctgcatttggaaattgaaaatttaaagatagaacttttcctgttgattagggcacacggcagaaatttgatttttgaaaaacttttcaactgaaacacgtcttatttaaaactcctaaagtcacagttggttgcgaattttcatttaactgacttttccccaccagcttctgtgcatttgctctgaggcactctcaggatgtttggtattaacactgcagagcttccattctgatttaatttccaaaaactatcccagcgaagagggcttttatggaaggcaattcaatgaagcagggatacagtggcaagtggtaaactgagaattttgaaattatttattcgtaacttcctttcccattacagtcattctttcatgagaacatatctctgggatcatttatttaccattgtattattaaagtctaaaatatagcctggcacaaagtaactcaataaacgtttgtggagtatatttttctgtgtctcatattttcaatatagatttttttttaccccctccgagacggagtcttgctctgtttcccaggctggagtacagtggcgtgatctcggctcaccgtcatctctgcctcccgggttcaagcaattctcctgcctcagcctcccgagtaggtgggattacaggcatgcaccaccatacccggctgatttttgtatttttaatagagacggggtttcaccatcttggccaggctggtctctgaactcctgacctcaggtgatccgcccacctcagcctcccaaagtgctcggattacaggcatgagccaccatgcccagccatagtttttacaatcactatcattacttccagctaccattatttactggattggctgcatgataagttccatttgtattggtaggtttaggatttattgattaacagaacgctcaaatagttttcagtgtatcagtcttctaaaagcatctgattttccttttttccctgttatgctctaggcaagcattatgcattttgagccactgtttttttcttttttaattttttgtttgtttgttttttgagatggagtctcactctctcacccagggtggagtgcagtggcccgatctcagcttgctgcaacctcctcctccctggttcaagcgattctctaacctcagcctcccgaatagctgggatcacctgggattagaggcgtgtatcaccatgcccagctaatttttacattttttttttattattatactttaagttttagggtacatgtgcacaacgtgcaggtttgttacatatgtatacatgtgccatgttggtgtgctgcacccattaactcgtcatttcgcattaggtatatctcctaatgctatccctcccccctccccactccccccaccccacaacaggccccggtgtgtgatgttccccttcctgtgtccaagtgttctcttttttcagttcccacctctgagtgagaacatgcagtgtttggttttttgtccttgtgatagtttgctgagaatgatggtttccagcttcatccatgtccctacaaaggacatgaactcatccttttttatgactgcatagtattccatggtgcatatatgccacattttcttaatccagtctatcattgttggacatttgggttggttccaagtctttgctattgtgaatagtgctgcagtaaacatacgtgtgcatgtgtctttatagcagcatgatttatagtcctttgggtatatacccagtaatgggatggctggctcaaatggtatttctagttctagatccctgagacatttattcagccaaaaaacacatgaaaaaatgctcatcatcactggccatcagagaaatgcaaatcaaaaccacaatgagataccatctcacaccagttagaatggcgatcattaaaaagtcaggaaacaacaggtgccggagaggatgtggagaaatttttatatttttagttgagacggcttttcaccgtgttggccaggctggtgtcaaattcctaacctcaggcgatgcacctgcctcgtcctcccgaagtgctgggattacaggcatgagctaaagcgcccagcctgagccactgttttctacttgtaacaagatgatggtgatagttttctgctagttacaccataagcatgttgaaaagcgtaatggaaagtgcaaaagataaaattgttttgtgtttctcctggataaatataggccattactttttatcgttattaattttatgatgaaattcaatcatcttcatcaacgcaaattatttccattatgacattttaccgtcctttaatgagaagcattgttactaaatggtaaaagcaactgcttgtatcagtgaatgaagtgctaaaaatggattaattaaggagtacttaatttagctaaggcagaacatatcttgcagaatgttaaaaaatttaacatgggaggagttgtgcaaattttaattaaaatgttgtatatctattgtatatagtgacttgtaagtagagaatacatgtatgtacaatgcagtcagtgctgaatgccaaatacaaaatattaaaaataacaatatcatgctttaatgaattagtccattgccatgatatggtctacaacttagaaactccagcatttagatatcagatgatattataacataaatctcttcgtatgcaagcctcaaaaaataatccactttacttccagcactttgtccttttagaatatcacatcaatgaattaggttattgtttacaaccataggttttggttgtgccaacatataggcctttctgttttcatattttgagcattctggctatggctagtttatgaccagaagtgccttctttccagtttctctattccttttcttctcagtgaatttatttatttttgtttcctaatacaaaccctgtggggaggttgatgctcatcatggtttctaaatgacatcctctcacagtttttgttgtttaataaaactcttaaaagactgaccaactaaagctttgtgagtgcacatttatacctgctatctttgaaatcttgcttgttttcaattacacatgctatgcattataattctgtatttccattcctgcctgtcccttggcagaaacttggcctgaaatttagacagtagagcctcttctttagatttcccagcggtgtttgaaggttacacccagcgactggctaatcggacttccctgaggttgactgcccaagattagttttgttgaaggcactgctttcatcttacttactcacattgactttcttggggtgagggcatgttgaaagcaaactttgtgcgatacttggtcttcaaatacactgagatagtatctgagagaatgaggttaaggtaccatggcagtgtagtgcaatgactggtttctaatctgattttgactagcctttgaatttgccttcagaccgccatgaggttcaacttctttattcgaaaaatgatcaaatttcgctaaatgatttatttgttccatagtatcctcaaatatgaaacactcatcagaaacggtgttattgttcataaagtaaaatctctagcagtattgtgagttctcactattttcattctgagacggcttcaaagattggataagcaattattaaaatctggtgtccgtgagcattttatgtagtagagtcttggtgtaaaattacgttcatgtaattgttaagttcttactttggggattcagccactgctctcatttcataaaatcttaatgtcgtgtaataagaagtataaattacatcccatcattttcatactcctcaaatactttatagtactcattatcataccattgcctttagtcactgtcttacataattctcatcaatttctatgactttaactgtcctctgtattgagtttcttaacaaatacttaggtgatcacagagtgccaggaattggccttagtgcagtcatcataaatgaggattaccccgaagtccataacatttattttgatttcccataaaaagtaatgtttataattatggggtggctcatctgctatatactcataatctaacatagtctaagtatattctatagcacatgacaatcacttagcacatatggaataagtgataaatgctttttccttctaagtaaattcttctggcttcctgttaatagtatacaaatggtctcctacaactaggtttgtttttgtgttaatgatagaaacagcaaaaatatgacaaaaatgacaaaaaaatgcaacatagtaatggtattaaggttcaacaaactttacagttttactaaacattggatttgggcttcataacatcttaaataagagggaatgctcctggtcaaccacagtctctgaaaggagcgtattcttaggttttgcggggggagtcagaagtccagcaatctaagaacatttcagattgggaataggatgatgatagctttagaagcgtggtaactcaggtgagaccattgttaattagtttgagaattatcttcattgaagtgaatccactctggcaaagtttcagaagggagtgtttgctgctggttggctgggggaagcatgataagaatcatggaggaactaattgttaaatgaataaatagggtagattgaaacttttgttggtgtctacttgttaccatggctgcagaacaatcagtgtcctctttcgtcctcttcctcctttgttttattgtcagtttattaatctttatatcctaaggctgtagcacataactttgtatataggcatttccaaagactgtggagtaaatgatttgaaaattgaatgaagtcatttttgatccatcttagaatttttgtcattcattgacttgttttcatttcccccgtacacagttgtaccttagatcttgaacactttatatctggattatggtcctagcctcctatttctctcaagttttcctccagcaatccattctgtacttaaagaatttactttaataaaattttgatggtgtcaccctctcattgaaaagtatttactctctagtctattgaatgaaggccaggttttctagtttgctgttgatgatccctcagttttctatgtacaatctaccagtttcatcttagttttcactactctactctctctaagacacacaaagccactgttgccaagacatcgctaatgtgtccctacctctgcatgtttattctacatattcccactgccccgaatactcttccccattccctcatttccagctattgaaatcctatgcataattaattcagtttcctatttaaagagaattgccttatcctccaatattatatgattttaaaaatctgaacatgttaaacaactggttgtgccaattagaggaacacattttaaattctgttcagcaatgcaattactttgtacttctattatttactttcttattccaaattagaagcagaattcatgaattttctatctttcaaatttcctggataatccattaaaatactttgaatataatagatttcttgaaaatgtatgttgatgaaattcaaaatattttagaagacctaaattcctttcttcaaaaattacttatttctacctactggcagttttgaattccacataatctcagaagtgggatagtaatagtttggggcaaaatggcaatagtttggttaaataagtgcatatttattgtaatgactgatatttatgaacagctgcatttagtccacatgttttatgtaaatgaaatttattacaatgtttgaaattttttggggggcaataaaaataatgcttggccaatttttcaccattttttactttttataatggcatatatttgagaccaaacatacatgcatgtgtctatgtataacacagcagtgaataggcacaggctcaaccctttttgttttctcacatcatggttttatttaatatactaaaaatgaaagagctctaagttatgctaatcacaggtacagctgactagttactagtgagaaggaagaacattttctagaatttcaagatacggtgaagtatagtatctactatataagaaacaattggtcaaatattttgaaaaacaattatcaaatgaattggagatttctaggcttcagaattccaaagctaagtttgtaagattattaaggaaggcagtgttcatgcacaaaatattatttagttcttctttaaaaagtacttgcaaaaattactttgaccatctgttgattaataattaaagtgtaataagttgagccatatgtgttgtataactttgtacctttcagccttgtgcattgaaatgtctaatatcatttgaataaatgaataaaacaataaaacgggagatgatgtaacagtctgcttataagtaatgtttttggcccttattcaaaatgtagcagactagcagtttcagcatcacttgggagactattgcaaatgcagagctccaggctctaccccgatctattgaatcagattctgtagttttaaaagatccccaggtgattcatatgtacattaagaattgagaagcactgtattgttctacggatagaagtagaccaaggaacattaattttttcgtctcttgtaactctttttaaaaatactttaaaaatagctgttctgattaatcatggttctgatacttgcaaaagaattgatgaagtcacttgttcaacctgcttttgtgctaacggacttgagactttactcttggctttttcacttataatcagaacacctgatcagaatatacatactgaatacagatatcttaatagtagttaagctaagataaattgtatggcaaggaaaatacattgccacattaccttgacctcctgccaggatttatgtttatcttttatctttgatttttatattcattaatgattaaaaaactaaaattgcatacatttatcatgtacaacacgatgttttgaaatatgtatacgttctggaatggctacattgaactaattaatacatgttttacttcatatgcttagcatgtttcatggtgagtatacttaatatctactctcgcagcaatttttaggaatacaatacattgttataaactaggttgtacaatagatctcctgaacttatttttcctatctaactgaaattttgtgtcctttgaccaacatcttcccaacccctgccccacagcccctggtaaacaccattctactctctacttctatgaattcaactttttagattccatgtgttagtgagatcatgtggtacttatctttctgtgcctggcttatttcacttaatatcctccagatttacacatgctgtctcaatgacaaaatttccttctttttaaaggatgaaaaaggatgacaatgaaatgctagcatttcatagtcagaacttatgtgttaacatttctagtactaatgacatacttcacataaaggattactttacatcttggttcactggaatgagtgcagtaagtaaattttaatgccaagtagcaaatgaatcttttgaaggagctgccactttatatgtgttattacaaagtattattgactttaaatgctgcgtttcattcactttctggatgtggcaaaggatatgaagtcagatcaacttaatgtgcgggacttttacatttgtctctaatgtctgagaaggaaagtgatattctactttatcccatgcaccacaatgtaaacaaatatttttaacatacacggaatagtaaaaatcattatatggtatttttctgtttaatttatattgtggatacatgactcatttcagcagagacttatttagctctctgcatactttaatatcagcaacattcagttaaaaggtatcaggtttctttactgagaaccaaagcggtaaaccattttgtgtatttgtttaattaccagtgcaccatttgaattgacatgttaatataactttccattggagggaaaatgtaatcttttatttttgtttcttatctaatgaaagctactctgttagatgggctagtttggcaatttgacttaggaaaaagtaatatggaatgaagtttttatatgaacaaggaaaataaattaactttactgctcatctcattggtctgccaaattggaaagacattttaggcctcattctcatgttctaattagtctctggaggacattcatggacaattcactgttcattaatctatcgtcttcctttaactttgatttgttcattatccttttagagtctcaaatatagaaaccaaaaattgatgtgtagtgttaatgtgcttacagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacaggtaaagtgtgtaaaggacagctactattcaagatgttttctgttttatatgcatttttaggtattacgtgcacatatatatataacttatatgtatatacacgtgtatatatacaaagcctaatgtatgtatatgtacaaaaagagacagactaaaccttttcaattttgcttcattgactacaatattcatttcaaaacatattttaaaaatactattcatatgtaccatatcataggaatatagaacataatatattaaatttccattgtgtaacacacaatgaaatgaaaggcaaacttacgtacatattaaactctaaaatcttcatcaactagaacaaagagctagagaaagattaaaggcaaatacagtttttaatcattaaaaaatactttatgacaatatgatgtacaaagtcagattttgattattcaggataacaattttgaaaatagaaaagtgttttaaactatttcaaataaacaataaagaaaaacatgatgaaattcttcgttacataattgtatagaatttagtggggttcttccatgacattggcttgttctttctctcaacagtgggtggtttggatgttttcctatgctttctcaggcacaaacaacagtgaagaaacctttagcaacatttctgctgaatgtgtggagagctcttaggccaaactctctcactttgctgagctagctctgtattagcttatgaaatttttagtcctttccagggtatggacctgatgaattctgtttttatttactttggatttagagaaaattgcttatggatgcctgtttttgccggattgaagagtaccatcccatataaatgttggagttgtgttactttggaatcctcatggctaaatagcatgctcatatcttcccagatcatttactctccaacatgatattaagtgccttcattctgggagtataccaatttcgaatatcatttatatatgtttagtattaaacattgaatctcaccatttccatttaatgttctgttttctaccatgttggaaagtagtcctttcgggttacttatggtttttccccctcctctctatccactcccccaaacccttctctgcagatcacggtcagtctagcacagggatatgagagaacttcttcccctaagcctcgattcaagagctatgcctacacacaggctgcttatgtcaccacctctgaccctacacggagcccatttccttcacaggtctgtcaacatttactctctgttgtacaaaccagagaactgcttccaagataatctaacactgcttttacttgcttgaatttttcagtgccttttatctcctcgtgaagagctggtttgtttttccaagttttattgattccctcatgtgattctgctttgttattgagtcttctctaggtttactatacgttgattcttcataaatatgaattcccgtaatggtttctactttcattatgtaataacctctaaggttctctttgacaaaggctgctaatggttataaaaaacatgaggctcatgaaaagttttatatatgtaacttcgaaaagtgtaggtacatctgtgaaaattgctaattacactatttggggagatttttctggatctacgtaaaggaaatacatacattctaagtgaattattttatctattcattctaaaatatatattctatgtaagaaaaatataactgcaagcttcttcatatgctctcctttaattttgctaatttaaacttgtgtatagcaggctctgtagtatttataagaaaaagtcacactgaaaccaggtcatattctcggcaatgtttagtactttctatatgaggaagactcagtggagttttccaccctttcaatattgtatggaacccaatatacaagaaatagccttataaatgttacagcgtgggaatgaaatgtgctaggattgctagatttgcaagaattactttttaacaaaaatgatttattttgctcaatggagccaattcgaaacgtgctagaggatgtgatttttatcaaaactacactatgaatgggagtttaaaaatgatagacctgatcctatcggctaaaaaatgtgtacatttttggagactcaattttttgttaagatagtggtgtgcatttaattagtaatttatttggcagttaatcgatgcattagctgaaaattctaagctttgaaatagttatgacctccatccttggctagtttacttgcaaagctctcttctcactctctctcattctggacctcttgactctccatcgactctctagactcaatttatcaccattccctccgttgaaatcaccaagacttaaggaataagtgccacctcctaagattaaggagcatacaccaagcaaagatataggggtttttttccccctctcattatcactttattgagctgccttttctaggttttctccaatgcctattctggtagcacattttcacctcatcaccaccttcattaaggcatcgctcaggtatgactccttaatgaagtaattacaaatggacttacatcttgctaggctctgctcattctacctttgtgtaaatattaccaaatacataatatgtcataaatcacagataattcaacaaattcacttacttgttttatttaaaataagccattcaaataaatgtaatgtttatcatttaaaaaagacacagcacaaatcacaagagatgggggatggggaatgatatattctgtcactaaaggaagcatatcagaagatgatgttacatgtagttaggtttgataagtgtatgccttaattattcacactaagaacatttatttcaaaagtgtcaaaaggactgagctttcactgcccctacaggctgtacctgctctacttcaaaggaactcaagacaggctggatctgattccatcagaaagctttattaaagtgtttacttgctggtctacagagaaaaataacgttctctataagaggagagagccatgtgggtgactgtcccctatggaaaacacgtgcatgccctcactccccagacacatcactctgctttaacttcatttatttattcaacaaataagtattcttaatcacagagacaaatggcttttattcagctctcctaactttctaccactgatgaaacatttttctcagcctctacactcagcgggttcttcctctctgactattctgtgtctttcattacctggctctttctgttcttccaacttctttagcttatgaaactcatgggaaatatcttggcattcttatctctgtacttgttcttttatcaacataatttaataataatttaataacctggcttcaatctgtattcaatctgtatgcaaatgatcattgtatctctgtcttcaccacttccaatcttacttgagttatagccacatttccaattaattttcaactctttgtatgtatctataccttgatatccactaatatctcaaacctagtatgtctccaagtgaagtttattatgaagtttcttgtccattttttaatgttattcagagccctaataatacaatttttttcgcttaattttgtccatataacaaggctactctcctaaactgcctcgaaaagatttatgatatattaatattttatatttttatgctcattacacacgtatttcatgttccttcaaccaaattacatcactcgttctcccacacaggtgccccaaaattttccatattagcttttatgcttcccttagctcagagtgcttttgtctctgttttaaattggccaacttaatttgtatttctaggcctaattagtaagtggcagaacctgaattcaaatttgcatttattcaactccatgcccatgctcattatagtagggtgacgctgcactttctcgacggtgattcttatatattgcgttacgcacacatagagcagtattcatacatttgattatttagcgcttgtgtttgaatcacctattatgtgccaggtactgttattgaagcaagtgacacataaacatgcaaaacaatctgtgtctgaaagtattctaattttattatcctcctgctgtcttccctcatgccatacgtttttaactcatttaataaatggtaaggccgggcgtggtggctcatgcctgtactcccagtactttgggaggccaaggtgggtggatcacctgaggtcagagttcgagaccaaccgaaccaacatggtaaaaccccatctctactaaaaatacaaaattagctgggtgtggtggcgcacacctgtaatcccagctactcgggaggctgaggcaggagaatcacttgaacccgggaggtggaggttgcagtgagttgaaatcatgccattgcactacagcatgggcaacaagagtgaaactctgtctcaaaaatacataaataaaaaaaataaatggtatgatatgagccttttaattttatctgtgagcttttctgtttcatgatcctctagcatagcatatctggtagcagaattggaggccaatatttcatcaaagtcatttccctcctgatgcagtagatgtgacttatgaaataattagagaaatcaaggattaccgtgaggtttcttacttaagcaactggccaaatagagttgccacaaaccaagatgggtgagactgtagaaggaacaggtttgggagtgaacgttaggatttcagttttaaacatattaatcttgaggtgcctatgaggctatgaatgcatgtaaagaaggggttctaagatcagagttgaggataataatttagaagtcaacacatagatgttatttaaatccatcggccaggataagattgccaaggaaaaatgtgtagacagatgagatctctagatgtatatatgatgaggcatcagcaaaggggctgaaaaaggtggctagaaaggggagagaaaaaggagaagatagatgtggcattctggaatccagaagaaagtgttttcagagaaaggaagatacctaactacattaaatattgctgatgagttcaaataacatgatgattgaaaattattcagtgaatttaggaaaacagtagggtacgatgtctgggaaatcctaatatatagcagttactacagtggaattactaacactcctattcactcttaaaactttcccattttgaccgataaagttacatgctctctctagtttatatcccctttaataagaacaatttcagtggtgtgtgcatgtgtgtgtatttggaggtgttgctgattagagtaggttcaaacgacagtaaaagtgaaggctaccctcattgtaacacttaaaaaaacaaactacaccgcgagctgggtgtagtggctcatgcctgtaatcccgcctcttttggaggatgacgcggggagatcacttgaggctaggagtttgagaccagcctggccaacatggcaaaatgctgtttctactgaaaacacaaaaattaagcgagtgtggtggcacacacctgtaatcccagctacttgggaagctgaggcatgaggattgcttgaagccaggaggtggaggttgcagtgagctgagatcggccactgcactccagcctgggtgacagggcaagactcggtctcaaaacactaccctgaatagttgatggccacagggacaaaaacatacttcttttaaattaacccatcctgataactaatcatgtgtctatatgtattagttcgatttttgatgcaacaactacaaacctagtgcccctaatcaacacatattcattattttacagttctttagttcagatgtttaaaacaggtctcattcagctaacattaacatatcagcagggctgccttccttttggaggctgtagaggagaatccatttccatgccttttctagcttctagaggctgaccacattcactggctcattgccccctttcaacttcaaagctaacaagggcaaattgagtctttctcatatgacatcactcttacctatactcttctgcccccctacatctacttttaagagccttcattattacttacttgctatgtgaccttcagagaatttcttgaactctgggcctcagtttcctcatgtgtattattgaaactgtttctaactcatatagttattaggagtgttaaatgagattaattttataaagaacattgcatggtataagcacattgtaagttctcaaaacccggcaaccaatatgattactactttagatacatcaggggttagataagattttgtggtctgatctgagaaaatttttatgtttttattagcacttttatgagaagagatagcctggattctgatttataaacaaactcacaacctgtatagagttcggcaagttaatataccgagtaaaagattctaaggaaaaggatatccttttttgttctgaggttgctgaggaacaatcttggaaccatgcagagcagaacatagtaatgccttttataaagcagaaaaagcacttctgggtgattttacatccagcaatcctgtgttgggaggggatgaggcagaggagatttttcactctatctctgcctttgccccctcctggcacaacttgtccctcagactgtccacatattgtagaaagtaattggcaaacagaggatgggaagccagccagggagaccactccttagattaaaagtatcactaatttgcttcgaggaagcctttatacatcctgatgtgactgaacaaattacccagaaacagaattgttaggttttagctcaactctataaattggtacactgaagacttctgagtagaattttaaaactggaaggaaccttgaagtgaatatatgtgatgatgttattttcaacagttacactcttatcgtttaacttcttttgaaatttactttattgtgtgtaagaacacttaacatgggattcaccctcttaactgatttttaagtgtaaaatacagcattgttcagtataggtacaagttgtacaacagatcttgagaattttctcatctttcatagctgaaccttcgttaattagcagcttcccacttcctcctctccacagcctctagcaactactatttcactctctgatttgatcagcttgagtattttacatacctcttataagtagaatcatggagtgtttgtccttatgtgactgtcttatttcacttcccataatgtccttagggttcatccatgttgttaatgtggcaggatctctttctttttgaatattaatagtaatctcttgtatgtatataccacattttctttatcccctcatccatcagtggacactgaggatgtttccacatcttggctcttgtgaatggtgttgcaatgaacatggcattgcaggtatcccttcaagatcctgatttcaattcttttggataaatatccaaaagtgagattgctagatcaagtgggagttctgtttttaatttttgaggagcaactatattattttccataatagccatgccattttttacttcaccaacggtgtacaatagttccaattattccacatccttactaatccattttttaatagtaggcatccaacaggtataaatgtgatagctcattctgcttttcatttacatttccctgataattcataatgttgaacatattttcatacacctgttgaccatttgggtgtcgtctttggagaaatgtctgttcaagcctttagcccatttttaattgcgtttttagtttttttttttttgccaatgagttgtaggaattctttatatattttagaagataaccagttgttaatataatataaggtcttcaggtctgatcacaaaatcttacctaagccctgatgtatttaaaatagtaatcatgatattggttgctgtctttttgataacttagaatgtagctataccatgaagtattctttatataattcattttatttaaccctcctaatagctctgagttagaaataattctcataatatatatatatggtttgtattttcccattccatagattgccttttcacagtgttgatttgttcccttttctaaacagaagatttttagttttatgtagtcttaattctattttttttgcttttattgcttgtgcttttggaaataattgcgaggatgaatgtcacaagatttttccaatgttttcttctaggagttttatggattgaggttttacatttacatattttatccgtttggagttgatatttgcatatggcataagataagcaccaatttcattattttgcacgtggatatccagtttttccaacaccatttgttgaagagattatcctttcctccttgtgtatgcttggctctatcgtggaacatcagttaaccctatatgtgtagatttatatctgggctctattctgttctattggtctatatgtctgtcttcatgacaatacaatttatttttaattactgtagtttagtaatatattttgaaatcaggaagtgtgatacctccaattttgtacttctttctcaaggttgatttagccatttgggattctttgtggttccatatgaatttcagagtttttctctgtttctgtgaaaaatgccattggaattttgataaagattatattagttctgtagatttctttgaatgtaatgacaattttaagtccttcgatccatgaatgtaggatgtctttccatttgattttgtcatctttaatttctttcatcaatgttttatagttttcagtacatactctttgacctctttagtttattactgttttctttttggtgctcttgtgaatggaatttgtctcctagaaactcaactaatttttgtatgatgattttgtatcctacaactttactgatttttaaattggttctagtgtttttaatggattctagggttttctattcataagattatgtcatctgcaaataggaataacattcttcatttctgatttatatacctttacttttttttttttgcctaattattctagcaaggacttccagtattgccatcggtagaagtggcaagaatgggcatacttaccttgttcctcctgttcctgatttcatagaaaatcctttcagttcgcagttgttgtgatatgacctgcgatctttttatatatggcttttacattgaagcaatttccttctattcctagtttgttgagagtttaatggttttttttaaatagtgaaattgtgttgaattttgccaaacaagttttcagcatctaatgaaatgaacatgtgacttcttatttattctgttaacgtggtgtatcatactaattgattttcatgttgaaccatccttgtatcccaaggataaatctcacttggtcatggtatatgatccttttaatgtgttgttaaaatttgccagaattttgttgagaattttgcctctatatctgtcaaggatattgagttgcagttttcttgggatgtctttttctggctttggtaatgctgaccttataaagtgaatttggaagtgctccctccacttcagttttttcaaagagttcgtgaagcattggcattaattttctttaaaaaatgtttgatagaaatcacttatgaagtcacctcgtcttttgcttttctttgttgagagtttaaaaattacttactcaatcccttacttgtattgatctattcagacttttccatttttacacagttcagatttggtaggttttatgtttctaggaatttaaccatgtttttagattacagtttcttggtgtaaaattgttcatagtggtctctttatgaagattaaaggagcgttattgtgttatagtccaaaaacctagaggtttttaaaaaaatgatttagtgtaagtaacttaaaaacaaaaagttatttaaggtaaagccctcattaagtatgaaaattttataaggatagtataaccaaaatacatcatttattccactaggtgtgtctgcatttaggaaatatgttaaatgcctagcatgtaatttacatttattatttctgatcttcaaaaaaatcttacaaagatgtaactccacaaatggagttacctatcaaaataggttaggaaattgatgcttaaaaaaagctttgaatagtgtgggaatgttatttttcttcttgacatataagtgataattctaaataagaataggaaattttctgtcatccatgtcccaaatacatttcctgttttgtcctctgaattattctattcatgtttattttgatgtaaataagaattttaatggtgttaaacttttcgaagaacattaaggaatattccatagctaagatattaagatgaaaacaggagtataataggaatctagtctgtgggacctgcatatgctattttctctctattactcagttttctcatctctaaaataaagatactttcaactttccatggggtggctaaaataattaatgcatagtgtatgtgagaaaagcctccactatcacatagagtgttagaggggaaagactccattcaccttcttacacaacaggcattcaataagtagttaagggtaaagaaatatttacaacaacgtggatcaacactcttccattttgcattatatttataaatgataatgtaatcttaaaaatataagtcaaaaaatgtagaatgaaagtccatttttacatttggtaaagatatttggagtttctggaagagatgatatataattttaccaaccattctagaaaatgacttttttgtctcttgataccagagataggtccagaggtattgctgtggatgttacaaaaatagagtcaatttttgcgaaccaaggatatttgaatgctctcatttaagtcatgtttattacattttatgggatttgtcggttcctagaatttgaatgaattattggatggaatttagctaatctgtgttccggtgtttaagcaggtcagggcggcttatttgtaatcattaatagtttgtttggatctccacatgtaggctagatgcagtatgccttctttaggaagggcctcttaaggaatatctttttcaaacatttattttaatacttttttatttttatgttttattatttttcttttacaaatcaagtctttatggaagtaagaattcgtgttacaactgattgaccttagttgtgtgactcagttatctcttggcatacctgtgtaatgcttagctcacctgtgtaatacaggtgtgcttaccttgttcaccagtaactattgccatatagcaaatcaactcaaaacttgggagcttataaaaacaacattcgtttttcttattatctcttttgattctgggtctcagatgggttcagggcttctcatataggtgtaataaaatagtagatgaagctgaagtcattttgaaggcttcttcactaacatgcctggtggctactgctggaacttcagccagggcagttggctggaacatgtatatgtggccttatttaatctgcagtcactcactaaatgctggctggattccaagagtaagtgacccaaagagtaccaagcagaaactctattgccttttgtgacttagtcttggaagtcacatagtataacttcttccatagtcaggggtccatcctagtcaaggggcagaaacataaacccaactcttgatggagaagtatcagtgttacatccgaagaataacatgtaagatgaaacatattgtatccatcttaaaaaaatacaatctgtcagaacttacaagattcttctgaagaatccaggttagttgggaaatgtggctagcatggtgcctaacaggtgttcaataaagtgcactctacttactgatgactgtacttgttttaggtaagcttgtacagatcttcaaatatccaggctcctgattaagaagtttgagaatgtccttgcacataagtgtcacagagtaggagccgaaatggccacttaattgctttctagcacaaatgaaatttcaaatccatttggaaataatttgtatgtgtaatttaataccaagaatattaagtagacactgaaacctctacacctttcattttacaggtgaagacactcaagctgagatatgctaagtcatgtacctaagattacagagcagaaatatttggtctaggatcctgatatcctgaattttgttaaacatgatgtcttcttaaggattataattattttaagctaattcatcacactgtcacattttctgtagggcgatctctagtttctacattcattaagtaatttgattttcttttttgcattaattttattacaatctattttgttttcagaaaatattttaatatttttaatcttttctctttaaattattaaccttatattttaatgaaactatattcaaagtgttgtaacatcataattaagatacatgacaaccatgattgaaaatgaaaacttagatacatttctttcttttcttttcttttctttttttttttttttttttttttgagatggagtttttgctctgttgccccggctgaagtgcactggcacgatcttggctcaatgcaacctctgcctcctgggttcaagcaactctcctgcctcagcctcctgagtagctggtattacaggtgcctgccaccacacccagctaatttttgtatttttcagtagagacgaggtttccccattttggccaggctggtctcgaactcttgacctcaggtgatccagccgccttggccatccaaagttctgtgattacagatgtgagccattgtgcccggccatacagatatattccttaaaatgtataattagtggatacccatgcctaattttaatccctgctatagaattctggcagcacatatccttgcatattgtggtctttatctacaaataatatcagtgaaaaaatgtaataatgcttggttaatcaacataaacttgttaccaaacttgtagattaacacagagcctcctattatgtcatacatgtgttaaatccatgtgggtctcaaatctactagcaaacttttttgttttcactaagagtttacccccttaagcatgtcaatgtaaagaaaaatattaattcttttgaagagataccttatttagtaataattagagtgactttaaaatcaacacataattaacggtcacatattttgttcattataaagtttaatagaaatacagtcattttttaaattatgagaatgctatcaattaaatctttggggaaataaactatctttggaaggattaatgatgagttgatggtatcgttatgaaactcctcatttctagatcatctgcataccaattcagctacataaagtcatgttcctcttttatgtgtagcaaatccagattttcaagcttagcattttaaatacttacttctattaggtaacttatttaaagtgtaatgatgccaatgatgagaggtatgtataacaatgggattacttcacaataaaacttacttatagtgaatatttatgaaaatgtttattaggtgtctctgggaactctggtcaatttaaaatcttagtacattttatcttcattataacatgtcccaaggaaatttttggctgaaagattagcattataaaaatagaactttaattagaaatttctatattgtgtgtcagattgctaaatccagtggcaattatctgcttcctaagatatgtagtcctctttctgaaacattcaaatttactttataatacctgaaaaagtcatttcaagaagaaatttagatcattaatggaatgagaaataagattagcccgtggattcttctacttctactttataatttaaatttcaggtgagctaggtgattaaagtcattttaactatttggtacctcaaatagttcaggaacaagtatgccggaagcactgtagtattaccattaatttaataattgcttattggccacttgatcctagaagccaggaataaatgtgaaataaagtttttataagctcttaaaaatcttaacatttctattgcttcatagagcatgattatagttaattatttatggagtcaataaaggaatttagtatggcaattcttgcatcatgtattggttatgatgcttttaagaaagactctaaggaaagttagaagtcaaatataaagttgggaaaattattagtaacatttataacatacgaaggattgatagccctcatatataaataatgctgataaatcaataagtaaaactagaatgccccaataggaaaattcataaagaacatgagccagaaaatgacaaaagcgaaaaagcccatatatcattaagtatgtaaaaagacataccatctacttaataaaaaaatataatataaacaatcaaattatttttaactaccagataggcagattgaaacagtgataatactgataattttgcagaacataaagaaacaggaaacatcaaaagttgtaagagggcttatgacagaataaattgatgctgtccttctggtgcataattttttaatcacaaaatttaaatttaggagtaataatctggtaaatgaaatgatgtaagacatagttaaaacaggttttcaaagagggaaagtttaataaacacttgaatagtgatcaccataggattaataaaacttagggtaaatatttttaatgcaatatcatgaaatctttaaaattcatgctatagttatatacttaataccatgctgtaaagatagcactgatacatggttagattataagcaaagttttcaaatagagtatatatctgtgtgttacgtgtgcatatatatgtgtgtgtgtgggtatatacatacagcaatacacatatctaccaataatactaaacacttacatagggagtatgttctattcgaagttatacatatgggttgtctctaacagcactttatctctgtgcctatttccctagtctcatcctcataactagaactctaaatccattatgtatacacactgtgtgtgtgtgtgtgtgtgtgtgtgtgtgtgtgtgtatgtatgtgtgtgtgtgtgtgttttgtatgtgctataacatttcacttttgcttctatggtgcaatttttttcattggaaatttaacaacttactatttttaccgtcttaatttttaaacaaataagtcattattactcagtggcccttgaaatattgaggcaatatgtctcaaaaacttcttgttaggtgaatggttacattcactccttctttctttctttttttttttattatacttttagggtacatgtgcacaatgtgcaggttagttacatatgtatacatgtgccatgttggtgtgctgcacccattaactcatcatttaacattaggtatatctcctaatgctatcccttccccctccccccaccccactacgggacccagtgtgtgatgttccccttcctgtgtccatgtgttctcattgttcgattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtggcacattttcttaatccagtctatcattgttggacatttgggttgattccaagtctttgctattgtgagtagtgccacaataagcatacgtgtacatgtatctttatagcagcatgatttataatcctttgggtatatacccagtaatgtgatggctgggtcaagtggtatttctagttctagatccctgaggaatcgccactccttctttcaatagaaaattattgagtaattagtatgtcctagaaactaccataaagctctttaccatgataacccaattgtggtttggagatttactaatgtatcacaatatgcaggttaaagactgctgttagaatgtgttactagtcacttaatgtttattaagtgccatctaaaccagtcattctagatctggttattaaatttcactatgttataataactttttcattccaatgtgcactgtgaatcagcaagggaacgctattcattgtggtcatttggaaacccagcctgatgaaacagctactatctaggatactcccagtcactccgcaaagggaaagaaaattctgaaaggtcttgtgctggcaattaattgcttgaactggaagtgacatatctgcttcagttcacaactcacgagcacaactagttacatggtctcacccaacttagaactaagaaatatattcgtattacatgtctcaaaggtagaaagctggaaataaatatgaatggtgttaataactgctacactgctaaatttatgttgtcagaaacatctaaggacaaaatgaactatgaaataaaaacatggccatgctctcaaaatttgttttttttgatatgaactcttcaagcataaaaaattaaattccaaaattgaaatcataaactaagttaacttgctaaaattcatggggtcaaatatgtgatatttgaatactcgctaatagaaatgtctcaaaatgcaataaaaggctttgggggatagtgagccctctgtcagagtagtgtttaagtatagactacctaatgagactggttgtaaaaggcagtcggtcacgggacacatggcttattaatatgttcacttactatgtactggaaccatatagctgtctaagatgagctttcttctcctttgcaagccttaaatccataattctaatcgatgggtcttgtggaatagtggtaactattatggaatgagagacagtgaaccaagcatggggaacatatatggccatattattgcccttaaggaatttacaaactgagtaagtagagaagatgttgagagtagttctaaatcctgaaataatttcactttacactcggaagaaaatccaaaacaccatcgtgatttgttccctataggtatcctaccttctttcctacccttaaccccatttctcagctccagatacactggcctactagcttggcatcaaatacgccaagcatactttgagttcagtgactttacacatgtatctccctcttcctggaagggtttttcccccagttattcatatggcgcacttcctttaccttagactgcaaagagatcttttctgactaccctatttgatatgccactaccattgttctgtcttctttcaaagctttaatttttttcctcattgtagttatcactactgacattacgatatttgcaggtcgtttttccctaatgagtaaaaactccaagaggaaaaggactagaatatatactaggtacataaagcatattgatcaaatgaatgaaagcatcacgtttcttttatatgccccagtttgcgattgtattgtatattctaagagttgagtgaacagcaatacttaagggagcagctgcccgtgaatctaatatattgttcagggttttgaagcaggtcctgcaatataaaccctgctgcagcacagttttacgtcatcttccttctcttactatgaattattaatcccatcaacctcatcgtaatagaagagttacgtataaaagaatgagtaatacaaggtgggatatgctaccttgtatttcaaacacatgtttgatttttccaaactaatttcagtgattggagagatcgtacaaatatggatatataaggcttattactagcgtgatgaatgggatccaagaatcggcagtttatgcatcctacaatggtccatcgactcgtactcaggaagatttccatagagtaagttcatcttgaacagagctttttacgaggcttagataagaaaagaatgaaaatactttaggtgggacatgatttcaataaatggtattactaaagccatggaaataaccctatgcttaagagatggacgaaacagatattttggaatctttgctgctctaagattctttatcgcctaatagcaaaaagattagataaagaggaaaactatcacttactggtcaaaggtagaaaatgtatggagaagaaatcagtgaaaagtgatgtaaaatatgtaactaggaaataaataaggctagagaaggtaccagaagtagatgagcagctgtggactgttacccccactcccgtctcaaatataaggggcgtagcctgagggttttctgttcaaaacaactttgactgtgtgtgtgtgtgtatgtgtttctgtgtgtgtgtgctggggagaaaggttggggtgggtggaaggagagttgatggggggagagagacagcaaacaatgttgaggctcaaaatgaaatttctatttttaagtacattttgaaaatattggcttatataaagttttcactaatttttgaagtaatattaaatatatgagtcttttaacaaatattgggcattcataatttgagatgtaatacctaattttgaatgaaataattgtttttctcaataaattaaagcataagaattattggagatttttcaccattccatgagaggaaattttagtagtgtacaaaagtagattaagatttatagacagcctttggcttggagaaacttactctactcagtgcctgaggaccagttgtgaagacagtcttatttgtgttggacaaaaacgtcaggcctttgaaaaaaacaatattcaaagtcagtattttgattgtatttgaagttcttagtgatgtttctaaacgttacgttaaatattagaaaaatattttcatggtcatatgtgtcatggtcataatcaatatgatagcttagttttttaagagtacaaaaatttaggccaggcacggtggctcatgcctgtaatcccagcactctgggaggccgaagcaggcggatcatgagttcaggagttcgagaccagcctgaccaacatggtgaagccccgtctcaagtaaaaatacaaaaatcagccaggtgtggtggcacatgcctgtattcccagctactcagaggctgaggcaggagaatcgcttgaaccccagaggcggaggttgcagtgagccgagatcgcgccactgcactccagcctgggtgacagagtaagactccgtctcaaaaaaaaaaaaaaaaaaaaaaaaaaaaaagtacaaatattagagcgaaacgaacatcaacaatttagtgaacgtttcttgtgtcagtttcagtctcagtatactgtgaaaagggaatgaaaaaaacatgtttaaagtgagtaaaattgattgacgtggtctttttcagcatgttttaagtgtttttcgctttgccaattaaaacttctattttattatttacctaaatctaccccccagtaaacaaaatagtatttccattttcataaaaggcagttccttttctttttcatcacccccatctttagagatctttgactttctattttttctcactgcctgacattaagattccttctgttaaatgtttttgaattacatttagttcataagaaatgtttcccctagactttaagaactttcggacataaaatttttcgccaattttgttcattcacttaacaaggacaaaaaaccagaaagagttgggtgacaatttccattcagtaaatgttctttactaaatctgaattgcatattgtggaatcagtaaatgtcaagaacaagccagtctatcttttcacaaaaaaaaaaaccaaaacctcgttgttactattttctattgtttttctagtttctattttatttacttttgttctgatctttattctttccttctattaacttcccctgtggaataactccaattataccatatcatgaagcaaaacatataactgtagaaatacaaaaggctcaactataacactggactaagcattggctgatctcccctagcatacctagcaatattaatcactcagataattaggcactgtcctatatttttgtaagatttataactttaaatttttcattacatatttttttccagtgactttgagacttatcttactttttagtgtgttaggtttatcagtggtgattttattgttatacatgacctcataatagttgttttttctttcagtacatttgttttatgtttaaatttttatatttacatgattaacttatgcaaattatatgtttaaaaatctgttttattgccaaagttgtaaggagggagtcaaagttcctagtcatttatttattagaattattcacaggagtgacaacgtgcgtaagtttatgttgaccagtcaaattttctcttcacaaaggacagaatgtgaaaagcacagattcttttttggtcatggggcagggaaagataatataactctgactgtgagagaatgagggaggagtagagaagggatcacatgttagtgtttattcttgtttcgtagaatgtactcatattggcctggacagttgccctttgattttaggagattaaaatatactaagcatgtaggcacccacccatacacacatacacaacacaacacacacacacacacacacacggacacgcaaacacagttgctaatcagtctgacttttatctgtaattctggttctgctacttactaaatgtgtgacttaaggtatattactgcacattgtgctcacttttgtctatttggatattttagttgacatttcaccttacataaaaaatgtgttgaaaattgttagcaagaaacaccatagggcatcatcatctgctttgtgatacataaaacatttgttaaaactgttcttttcttctgtaaggacactcaacagatttatcaaataaccattttaagtgtacaatacagtattattagagacaacgttgtgtagcagatctttagaatttattcatcttgcatgatgaaaattttatgcccattaattagcatttccccattttctcctcctttcagcctctaaaagccaccactctaatctctgattctctgagtttggcaattttagatacctggtgtgagtagaatcatgaagtatttgtatttctgtgtctagcttttttcatttacaatataccttcaaggttcatccaacttgtcacatattgcaagttttccttctttttaaagactgaataaaattccattgtatgtatttaccacatcttctttatccattcagctatcgggcatttacgttgttcccacatcgtgactatttttaatcgtgctataatgagcactggagtgctaatagctctttgagatcctgatattttgctctttttttgataaaatggcttcataatagttatttcctcatatcattattctaaaaattgagctgctaagtataaatctgatcacaaagtaaacatgtaaatattattttttaatcacacatgaaggatttttatagtaactttgtgtaaaggtgggtattttcttgtaagttattggaatctattaattttaagggagcattccaaattttaagaggtagaaagaaacaaaattccagtgcctatgtagtttatttcattttaatttaaattatgagatgattgaatagtgttcacattagaagtataggaagatagtttagaggtcaacttctttggtcttgtatttctttttgttaatgaaattaatgtgtgttcagtggaaatatgcacatgtgaatatactgttagtttctttaaataaattatatctccaaatgatataataccatgaagccactacaaagttaagatataaaagagtttaattgcatggcatatttttacaatacattaaataactgaaaatgtagctaagacaacattgtgactggttttgaaaaaataaattatttgtgtggttatacatctatatatgtacttagaacaaaggttatattcagaatattttacactagactcttttcaattaattttataggagtttcatttctctgaattttcatttgtcagtgaaattacatattttaaaacatgcaaaaataaataaaacatgtaatttaaaaatgtaaaactcttttacatatatttttaaatgtcaataaatgaaaaactcttacatatatttttcaatttcaataaatgaaaatcaggaaaatagtgacatggtcttcaaaaatcacaatttaatagagaaaactgaagataggaaataatattctaattacggacaatgattaacactggcagaactggtaaatagtacactataaaataaaatactacattaagatatataatcagaggacatcatacctcaatacatatgtgtttgttttgttttttaaagacacgggctaacattactaattactgaaggatggagaatgttaactgagcttgtaatgataagccggtgcagataaataaaatggtataacaatcatcacagtttataaaaccctaagagtttgttaaatgtgcataatagcgtccacaatcccgctaacacaatctccaaacatttttgtgtacacatagtgtaaaggatccagaatttcaatcatattctcaaaagaattcattgccccaaaatggcaatgaaattctgagaaaaatagggtatggtgagactctgaggacttggaaagccaggcaaaatactacttatttctatggtacagacagataagtcctttatgttatattatccatgttgaaaatctggtagattgggaagcaggaaagaggtttcatgtttcagctgcaaactttgtgttcgtggaaagacaagagcaagtgctacataagttgagccattcccagaacaggtagtgaaagggctctattgcttcaactgaagaatgtgttatgctcttatgtataagagggattcttcacaccttataaaatgttcatatcccttttacgtgctttgtattatttatgccccagtgagcttacttgtgagataaaagatgaaatttttaactctgtcaactaaaaacaaccttatatatcttgaatgagttgaccaaagtagtatggttagaaactgataggtatgtcactcaacccaagttttccaatttctgggctctgaatcattttattagcctaagctccttcctgagtgttgatcttagataatgaaccagttactcttagataatgtctgtgatgatgaataatgtcacaaaaattactaactgatattggacaatcattatataacaaacattgctgtaaacacttttcatacattaattcaatgtttataacaaccctattgagaagattctgttaatatatccattttacacttgagaaaattgataagctggttaagaaatctgtgcacagttatgcacatgaaaagcagctgtgccaggatttgaacacacacacaatctcattccagaattgattctattaacctgtatgctaaaatgacacaacatagagctttatgaagctatcattagaggaaaggttgggttttcataaacacacttatgcacacacttcatgatttactaaaagtggatgaatatataagcaatataatgacaaattataaatcaggcaaccagaaaataagaaggtaaaatacaggcaggtttaaaataaaggttactttataaaatgaaaggtgaagtttgggaactggtaatgaggaagaataattgctgtgaaatctatcaacagatgacttcattaatcttttttccttgaaagagattcagatgatattaccatctctttcaggagtggaagagagagaattggagagaaatgttttaaagattctgatttatagcaagcctgtgaaaaaatggtgcattaaattcccatttggcatcctagttgtagtaagataatacatcctttctaaaaattccatttgatgaataagcaaaccaattcaaaatgactccattttattgataatagcatcagtgtcattaatgagaatgctttttgactaacagcaattaactagatttggtgaactgagcaattgaacattgaatttgaaatcagaacattcggcactgaagatgatataagtacatattagaatgattgttgattatttaaggatttattaagttgatgaagaacattaaagtctattatatcctgtattatttaggatgcttggtttcaaatgtactcaagatacaaagagaatttgttggctaagtaaagagttcaaggtttgctcaagggtttaatacagagttttattatggatttaaggagaagtctttgcttctctgttaatctaagcctaccctccataacttttcgaactcatacagaccggcttccctcagcagatcttggaaactcttttcccttgtttacagctaaatgtaaagaatatatctttacccaaataggaaacaaaaggtctgagtttctctctgcttggaaactcttagatcatatgcctggcctgaacacctccctgaagcaaagtacatagcagtatcccacttggcttgcacaaaaaccgagcgcatatctagaactgagagtaataacaatgctttccaaatcaccaggctactgtgccatcagagagtagaagaaaggatattgactgtataattgcagtgcttactacagtcctcctctttgaatatccaacattgctatacacccttcatagcatatattcactttcaaagatgctcagactcctcaaaaagagcaagtataaaacattatccagtgattgcattcagctccaaggttgggatatctgggtgattagcagtccctttcaattagtctttatgatccatccagtggactatgactaagtgaaaaaatttgatgtccagtactgctaagtaaaaagttagaagggcacatcctgattaaaactaaactaaatttataaaagaaaccaaattgaaacagatattatatcctgcactttcagagccttcctggtgatttttccttctgttcattataaattttgctaaatacttgtcttcatcatgatatctgaagttgacatattttggggttttgtgttactttattattctacttattgtgttgtttaaaagtcctggtgcttgccctaggtttgagtgataacaaggtgtttttagttagacctggggtttctttggcaatcagatttgtttactatttataggctttcagtatttgttcttatcaattccatgacccagtaacccaaattctatgatttggttttaggcttcaaatgttaacctcttttgacatctttaagaggcctctgtgctttgcacaatcccctgactgagaaaatttgcagcacagggttggggtagagggcatagccaatctttgagtatatctttgaagtatagattacatagaagctgcttcttcatgataggagggatcgtctactttgtcacaaaagtgctttagggaagcactatagttgattttttttagtacttaagtcttacattctgcctctcctgtctctgttcatacaaacattcgatttggagtaaaaatacaaattggcttttccactcatatcaggctccaaattatcagcctctcaaggcgttcacgttataagccacaggcagagagggcttcttcagacaaagctatattttcttttttttctgtacttcaaaaacaagtaaccattagcatgaggttttttctttcttggtttaaagaggccagtaggtggcaacatttttgtttctatcaaatctcctaatagtgttggtactcgtaaggcacatgacttaggataaaatagaccattgtttaatcaactgttttttaatcatgtaccaagtatcattttgagttggggtgggggaggtttatcatccttgtcttctcataattcagcctgttccacattataggatctattaactttcaacaacccacttcctgataccaaagtccatataaactagaatgatgtttggtacaataatggaaaactcttctcaagaaaacttgaaatatgcagacacacacacgcacatgcacacacatacacatacacacacatacagaaaacatccacattggagcagtaacatgtgacatcttttcttccattaaagatttcttgtaattaaaccttgggaattattggcttatgtaacagaaaattccaaaggaatggcaggattctggtaagcctttaatccaaatattcacattgtcatcacactgcagctccgtatctcagtggctcttttggctcttcactcttccgttatctatgccaggtagttatttctttccctatacagttttgttatgatagatggctgccagaactgtaacatttttttctttgcttatgtcaaaggaaaaataagtactttttttctcagtcaagcagaactctggacaccttctggttggaacatgttaagtcatgtttccacagttaatatactgtgttaaagcataaaatgttgtagttggatttttgttctatgtccctggcaaaaaggatttatttaaagcaatcaggacttatgcatgggattggggaggtgattaattgctcccaagccacaagattccttcataaggatggaatatagtttggaaattattttatggtagtatttgaaagagttcagtgttttcccatgatttaataatataaatccttaatagaataaaatatatcatgaattgcaagtgtatttgaaagtgtgtgtgtgtctaattttattggatccagaaaatatgctctattttttcttggaaaatgctgtgttttatatccactgcattttttttatgttctgtacatttcagttggatttctttcaaagggactgccctctatcaatcaaagtcatctttagcataggttaggctattactgatgaatcaaatatttctagagcaatactttaggacctgtcccacaactaatatattcaaaatttagcaaaagtttattgagtacctgttagaagcaaaggactatgctaggtgttctcatatacatgaagataaatatatgtcataaaacaatgacaaattggctttcagaatgtgcttatttccaatatcatcatatttttcttttctgtcatttttcattttatcatataaagaccttgaggggtgttttttcagagaaacaataaaccaatgatggatgagcccacttgagttagttacatactatacagcttatataaagcataagcatataaaaagtatatgcatctactttcatagtttggattgttatttaaatttggtggtattacattttcttctcacagatgactggtcttaaatgtgtactatagaatttacagaaacaaaccatagggtttaataagctgaataaaatgaagctctttatctggttagattactttgtaaaggacaagaataggggagcctcccaggtcaacctgatgtatgattttccatttttctaaataagttttattgacttttacattttaatggaaaatgagtaattagcagaggtgcagattatatttggcagaaaatgattataatatttttatcagagagtaaaatatatgcagaaatagccaagtaatctgatttgttaataataatagtatcctgattatggttttatcttttgttttaaaataacatttatatagggtcaattttgaagataaatgggaacctggtgaactctgtctctttttctcagagtgtgtgtgtgtatgtacataaatttaaaaatcgaagttatagttaattggaataagaagtttgttgaaaacagtttgatgtctggtaattgagaaatgtttatgaatctgacataatttactaaataatggagagagatacattattcagaacattatataagtacctaggccaaatttctgaaagatccaaggtgagagatatatgtataattatcttggtggtaatttactcatgagtagtattgacattgagatattaacaatttgtaccgacccacttgtagctgagtatatattcttaaattgtgttccaacataaactgtcatctatattggtggatctttgcgatgctttgggttaggtcatcaaaacctaagcaaaccctggggaatgtactttatatgtatattattctcccactcacacacacacacacatcctcactgtttagaagtacacatttgtcaacattacaatgcttttggcattcacagaatctgttcaaattagtacagtgttcactactgccatagcaggaaaaaaactgtacttttgaatcatttatttttaaatcatttgaagtagaaaattctgacaggttgcactgatgaatctttactaaaaataaaggtctttgtttacaaataattacatcttctcaaccagtggtttcatgttgcttactttcttaaaattccaaatagaacaaggtttgcaaaaatcgtcacatatacatgttatcactgttgactgttttatgataatttaggtagcattcattgtacacttacaatatggcaggagcatgtggcagttacttgaatggcaatatttatgaggtttaccaccaatcaagcttcccactatacagattaagattaagacttactgaagggtccttgtgctagtaagaggcagagtaaaatagacctaggcatcttgaattcctaaacctatgatttctaagttatgtcttctggcctttgtgttaaaatttatttctaatcaacagtgatacttttaaaatatacataatagtgtcatatgtgaaggtcaaacactagtaatttaatctgtcaagtacttactgatcatctaatttgtgttaattactgggtgttacttgacttgtcctcaggttctttatgcactagagaggagacagacactcttacagctgctttaagacacagtagagataggaagtataataacttttcatataaatcctctgggaccataaattatagcttcataaatcttggcttagcaggtagcagaaggtataactgaatgatgagccttgatagtcaagtatgatttttataaggagatcatcccatagaaatattacttcactttgtggagctaaatgagaaagaagcacgaatcgtcagttcattttgtgactgttcgtttcgtgtgtagggcatatggttaggggaggaggagtaggagaggcggctggaaaatgaggttgaaggacacattgtggaggattttgcatatcatgctcaaggagatacattttattcagtaggcaagagaagggcattggcaggttttgaataacaagtcatgtgtttcaaccctgggacttatgaagctgaatggagaggcactttgcctttaggaaggattgccaaaaaaaaccaaaaagggccatgctgagttgaaagtgtcaaggttgcctccagaataagctaactgtatttggaaatcagggtttattatcaacagatcagttaagaccagtgatagaatcgcattgcaggggctagggtggagagagataacagagtaatcccaaaaagtacatgaaatttcacagagaaaaaaagtacaatcaaatttgaagaggttcaaggacagaatatttgattgattgttttgttgatcgatctatctatctgtagggaactagaggtgggagacatagttaggtacgatttaagagtttccttaggaaagtaccatcacataacagatatttaaaaagactttaaagaaggtagttatgttaaacagtgctgcaaatgaattgaggaggatgcaggtaggggaagggcaactggatctactgttttagaagtatacttgtgtgctgtgagagggatttttaagtataagtgtggaaaacaagaaataatacatagaattacggctgattatgggaaactggaaggaggaaagtttaatcaattctgaggttcagtgatgaaagtaaggaggagatgggatagttcatagaagaatgatgttaatatttcagattgggagagaattaagagttctgataaactcctaattttgatgatacactctgtggtaggaatctacagtacaccgtaaattcctgtgtataacatacaatgtgctatataaaatatgtggtatcaacctataaatgttgatttttcaggacaaaaatgtccagaaaaatgtaatgaacattcagcatacagcttcgataagaagttttaatcccattagtatttaactaacatactcccatttttagtaagtgattattattagtattgattcctacttaattctcttcaatgccgtagtctctgtattttcctcccttcattaaaaaaaaaaaatctttcaagttcaagttttatcagagagcaagatggcatagggaagagagcagagaccatgacatcactggaacagtttaacatgatttgattttataaaacatgataaaataagtatcaggcggcattttgttttaaaacacttgctgctggaattccactattcatatgataacctgctgatcagtaggactctgtctcctgatgccaagtttttagcaccttctacagcaatgtgtgaataatgcagagatgcgaaggaaccttttaagccaacttgagaaacaagccctgtcaaaaacatgatttctcatgactgaataatgcaacagactattccatttagaaaaacatcagtaaatagtctgagttttgatagtgattacattcttacacttgaggtaaaaaaaatattcttgtctcagtccacaaagttgataggcatagggacatatgagtgtatacactgagggtgtttaacaatgaaatgtgattcaaaaatataacaagatttgataagcaaatgggccagcaatttgaaatgcttcaaattatacttaggctctgagatgaaatgtatgtcatttaagtgtacttttttttttttcccgagatggagtctccctctgtcgccaggctggcatgcagtggcacaatctcggctcactgcaacctccgcctcctgggctcaagcgattcttctgccttagcctcactagtagctgggattacaggcacctgccaccatgcccgactaatttttgtatttttttttttttaaatagtgacaaggttttgctatgttggccaggctggtcttgaactcctgaccttaggtgatccgcccgcctcggcctcccaaagtgctgggattacaggcatgagccacagtgcccagccttaagggtatttttaagtagctcatcaagatgcaattagatttaccattatctgacttgagtagaaaactggaaaaaaaaaaaaaaaaaacacaaaagcagagaatggtgagaacttttaagcgaaggtgtagccgacccagtgtcaaatagacaaaatgtagaaaagacaaatattatacatgtgatcttttctgtcacataatgttgacccctaggatttccatcttatgctttcagtaacagtaaactacaatatttagtgcagtattagatgattatcatgtcctaatacatttcctccataaaactagaagaatggcacttaaggtccaatgaaatatgatggttaaatataatatttgtactcccttgttggtgttgcttaatgcatttcttaatcctccaatttatcgtgtcacacagcactaagctcaacaatttattcataaagtggctgcaaatataatttggaacaaacttttttttgttcaatataatttatttatttattgcttgtataatcacacaaaagtgtgagttccatgaggacagagacagttgtctcttctgtttactacaaacgtcttccgggccagtaataaccagaagttgttacctgttaaataaactgaaagtcaaatgtagggtgatttctacgcatgaggagttctagagctcattgatgtcatccaaggtttaaattcttagtgtaatgtattctaggctcatccatgttgtagcaaatggcaagatttcattctttttttaaggactgaataatattcaattgcatatatgccataatgtctttaatcatttatccatggatacttaaacgttgtttccatatcttggctactgtgaacaatgcttcaatgagcatagaagcccggatatctttacaaggttgtgttattttttcctttgtgtatatgcccagaaggagggattcttgggtcatatggtggttttgaattccttgcctcacaaaaccttgctttgtctttgcttgctgtttttttttttttggagacagattattgctctgttgcccaggttagagttcattgacccaatttcagctcactgcacccctgcctcccaggttcaacgattctacttcctcagcctcccaagtagatgggactacaggcacccaccaccacgcctggctaatttttgttattttagtagagacagggtttcaccatgttggccatgctggtctcgaactcctgaccattcccatcaatgatagactggataaagaaaatgtggcacatatacatggaatactatgcgaccataaaatagaatgagttcttgtcctttgcagggacatggatggagctggaaaccatcattctaagcaaactaacccaggaacagaaaaccaaataccgcatgttctcactcataagtgggagttgaacaatgagaacacatggacacagggaggggaacatcacacaccatcgcctgtctgggagtggagggcaagggtagggagagcattaggataaatacctaatgcatgcagggcttaaaacctggatgacgggttgatgggtgcagcaaaccactatagcacatgtatatttatgtaacaaacctgcacgttctgcacatgtatcccagaacttgaagtataataataaaaaaagacacctaggaatcattctcaacaactgtactgtccttgtcatatttatagtgcccacgtccaatacactctaagatcatatatgtcagaagtctgtcatctccccctctttccctacttctgttttgttgaagtcctcagtatatatctcatcaattcattttttcaacagttcttgagttcttatggcagcagtcaggttctgactattacatactgtcattcactggatatctaactggtcttgctgccctcatcttccatagatcattctccacactgcatccagaatgatctttcataaatataaatgtagtaccaatgttcatggtttgactgtcaattcccccaaaagattaccgggaaaacacgttgatgaaacaacgctgagtgtattagacatggcgccataagggaagacactaacttgacaaggtcttagtagtgtgtaaaaattcctacttctcagttcatatttcgcttcccttttcaatgcttccatttcttcttggacgtgttcttatgagagcacatatattttttgcttacttgtaggtttcctccactggactatgatttccttgagggcagctcttttattctttatatccattgtgatctaagtgagtgattaatacatagttgatacatgaatccacaatatgtgctcattttagtattaattgaatacataagacattgcttcttaagtgtgccttaattggcacaataacaaaatttgttgaggatttactgaagaccaggttcttccatgctgtatgtatattattaacatgtttaacttagcttaccaacattaggagtttatattcttgttattcccattttcagacgagaacactaaggttcagtggtacagaaaagaatttgagtctagatattttgattccacagcccatattcttaattctcggtacactacacttctctagcatgtttgataatatattggtaacactcaattgccaaatgtattctgcatatatcacaaccagtatcctgatatatgttggttgggttatgaaatgacacataatttgttcaacaaacatttattaagtttttacagtatgctagccacaatgtgagattccttatatgtactacctaaattaagtaacttaagtaaatgtaggaggatttgagacatgcatttactttcccctctttgatttctaaggcaccacacattccaggttttcttcctgtttttctagcatctgctttgattttaatttgctggttcttccccatcaacacaaattcctgatatgacagtaaccaggggttggttcttagaccacattcattttctcgatgatcttatctagcctcctggcatcaaatactgtctgtaagttgatgcctcccaatgtttacccccagctcagagctttctgccaaactccaaacttagatacacaactttttatacattcctagtcaattcaaatttaccctatgtaaaactaaatttactaacacccacatctgcttcgtcaatagtttttcctgtgtcagtaaggtttcactatagccttccagttgccccaaatgaacatctttgagtcaaacttagtcttgttctttctcacacctgatgttgttgattagaaaactatgccaggtttggccggatgcggtggctcacgcctgtaatcccagcactttgagaggccgaggcgggcggatcacgaggtcaggagatcgagaccatcctggctaacacggtgaaaccccgtctctactaaaaatacaaaaaatttgccggccgtggtggcaggtgcctgtagtcccagctactcgggaggctgaggcaggagaatggcgtgaacccgggaggcggagcttgtagtgagcggatatcgcgctactgcactccagcctgggtgacagagcgagactccatctcaaaaaaaaaaaaaaaaaaaaacctatgccaggtccaccttaaccaggtatatatccagaatctgatcacttctgactacttacatggccaccaccatcacctctggtctaaattagtgaaatagccttttaaacaagcctgcctgctttggccttgccttacctgtaatccattttgtctgccagatggtcttgttaaaacgtaaggcaaatcacatcactcttctgctgaaaaccttcccatgccttgccagacattcagtaaaatgcagtcctgctgttttataagcccatgcacaatcacctcctcctttctctatgtttcttctctggcttccttttccaccgttgttaccgtctctcattccaccgcagtcatagatgcctctacctggaacacatttcctccacatactcacatgacttactctctcatatctttaaatctttttctcaatgatattttccctagtactttcaattccccttccttgcttccttttctccataacacttacatccttctattttacttatttctcttgattagcatgccttcagtgacatgattcactgaatgagaacttagatttctgtctgttttgtatatggctatatcatcattgcctaaaatagtgcctggtcctttgtagttgcttaataaatatttgttaaagcaacactatttgtactaagtgacagagccagaattccatatgattttcaagctcttctctataaaataaatgaagttatgatgtattgaatgtataaaggctcttttgttagttgctcttctacctggcaagtctgtaattaaaataattttgtaaaaaattatctatttgaagtttttttattatttgttcaattgccagtagataggctagacaaagataagtttaccaattgattatggatatcttacattcttattaaaaagcaaaataataatggatataacacattattattttcatgattaaggatatatcacctctaatgagtagatactaaaagagccttaattttctgattcccttatttctcctcaaggcaaggatagatatccctgtgctgatggcatcgaatgcattggcaagcctaaaatcaaacaagctttctagtagactccactcaagattatcatcaatcttcctttgcaaatttggttttcagtttttgtcttcacattgaaaaatagtcaatatattggcaacaaatgtaatgcattactcaatggcaggtgatatcgctaaagatggtcaattacatgctaaaaacaaaggactttgaggtctgttggatgccaaaacctacagtcaattcagtcaatatttttgacagtacagagggaaaaatcactcaaggaaaattgccacagtatacattaaatatctttgtttatcccattttagttattttgtgtgatatctctaaatgctgttctgtatatgctgctgacaaggagcaaatttatttgtttagaaattctgcagcctttccatcctttgccttaactttcttgttgaggtactaatgagctgtgaaaggccaaatgaaagagaaataacacctccagataatctgtactctgataaactactcccagaataattgggagtttatggttgttgtagggcagtggaagaaataagcaatgttggccaactatacggaacaacccgtgttaataaatttgtaaaagaagtttacaaggcaatcacaatcctttcaaacaaatgtcatgcatgtactttcaggcctaggcacaatgttattatctgaaaagcttgataggtaggattgtattttgtcccactatttctaaatcaggaaattctaagcatacttgtgacgatttctcttttaccttaaatggcttccctattccagatttacagtttctgcatgagttttctactcaatttgcataattttaatttacctttatgttaaggtttttgaagagctgccgtactttcatatttggagtttaacatattttaatttatggacgtggcaataatttgatgacctttttagtgtaatataaagcctatatataaaaacttccaaatagaatatgtactgagtttgtaggaaatttataagtattatgcaaatcaagaatatggtagctgattccactagaggctattttgaaaatataaagaaactttgtttttaaacatagtattgattatctcactatgtgacaaaaaggtatttctgtttattctgtttctttccatttctgctttccaaagtagaacaaataagttgaaatgtaccaatgggtgtgttttaagttttgacaggtttcgggtatgattatataccaacaaaatcccagtaatatttgctgcatatttcattgtatctatattttatgtactgatttaaaatttaaaatgtgagtaaattttaaggcattgtgctaatgaaacttatggtagttcattttttatttttatatagacaagctatctgtttagaatgcaaaaattatatgccatatacaatcatattataaacatataaaattggtcacagaaatttctaagggtgaaaaagactggatgaatcaaagaaatctatccacaattctgtgagtgtatgagagacttagaatgatcacattcacataaaatataacacattattatattttgatttttaaattaaattttataaatctagctatctctgggaaatgtttcttccccttgagttattacaaaaaagtctggcaacaagttaatattcaggatttcgtgagacagatactgaattcagttcccatctctgctttttattagctcttcgaccttgggcaagtttctaacctttatgaatcaggtctcctcatagtaaaatgtagacaataatcatcccttatgttgtgaggttaaattagatgatttagtggagtgcttacaccatccctcacaaatggtaaacacttaattcactatacttcagttctggtggtaaattctaaaagaatttagatgatgaagacagcattataatttaaagcacagtctacacagtggatagcacccacttaggagatacacacgatgaactggggttctagaaggacatattataatgtctcttcacaggcttatttaagaattaagaaagaaataaactttaccaatttttaatatacaggttttcagataatttgatgtaatatatggtacttgatatcttctgtggaaaatcagagatccttaataggatgcataatgtcaggcctctctcttatttattagcgtttttggtgctcttgatgtgctgctatgtctatgaacactaaagtgtgtttatagattatgttatcttaagtagtagaatacttaaaatctttgtcagcaaaatcagagtaacctaggaaatctattttactacacagaaatgttctggacatctcatggcaaagtagttgaaaagattgagttatgtactttatttttgaaaaggtcaagtgttacataaatgctgaacattttcaggttggcaagtggctgtgagtactatgttatttctcaaattatttccaaaagcagaaaaaaaccttcaatctttgaaggagaagcttctgtattaacaatattaagaaagagactagattttataagacattcatgctatggagagagcattttaaaaatggatatttggtggtagtcccattataaataggtcagttataaaatattctatacctacagaaaataaatggaaagaaatgtcaaatctgtttaaaaatattataagtgaaaactttcagtgaggttttgtctctgtttatgactttaggacgtttactttctatgttcacctcacttagggttctgtttcgcttttctgctcatgcttccatttcctcagttggtaatatacacatatctgtacatatcctttaatcctcttctagtatcttcaccaaatcagaagtgattgctcttatcacttagcccaccctgattttgagttttttttttacttgaaaatatgagaagtaatgttagtataacaagagatggaaacttatcaaaaggtttcatacttttatttttctgaaatgcaaaagacttactgcgttcttctcagttctatgaaccctaagatcaaaagctttagttgtctatgggacacagagatacagaccctgaagcatgattactcctattaggagccaatgataaaattgaagaactttccactgctttcagccaacaggatagaggacttttattactttccttgaggcagagggtggaatttgcaggtgttaatgaaatctaccagagtcttcccaagaattaataccattctttgaaatggcaggctctgaagacctttccttgaataggaaaggaataggaagagattccaagaatctctttccttgaatagggaagccaacactgcattgaagaaggcagtaagtgaaataaacaagtggagtttgtgtcatttcttgtccctgctctgtcatggaaagatgccttggtctaattctcttaggaaaaaaaatgtcctcatatcagtataaggtaaaatggaatattgttacatgtcatatgctaagagacacattattgtattcaacaaacatatagtatgttatactgtatgtcaggtgctgaacaaaataaactgtctactgtcgtgaggcttccgagatgctacatcacctctcataaaagaacttccccatttccacaatcacacccttataattgtcttcctaattagctcactagttatttatattatttccctaattttaataatgaaactatcccacagaagcactatagatgcccaagaagtagagacaggaagctacccattagttcccccatagggatttctctcccttatgaaggatataccacatctttgtttaaggaataaggaaaagagacaaaggtatgtaacataaataaagagaaagcacacagaatttagtgatatatgtgaaaggtaacgggataaaccaagcaactggtgtatgttaaggaggtgaatatagctaatgtccttggagaaaatttacctagttagaaaagatgtgtcaatttagtagaatatttttacaacctaaaatctaattgaaccaaactcctctttattgttgttagttctctattctgggttgcactaaataaaaacaatgaggcagtgaaagtgattttataaaagttgaatggcaaagggtgatgctgaatgtcaatacaatcgctgtatgttgtctgtgagccttacaattaccctctaaattagtatcatatctattttcaggtgtgtaccaagagtgtgaaattaaaaaactttgccaagttcaagtacacactacctataaattccagaacctgaatttgacctcatgtttattttactccaaagtgaggccgacttaaagtttcccgaatgcggccactggttttatgcagcatgatttctttgagacattgttatatacagcaatggaggtagggcagggggagggcagtgagatttcagagatggctagcttggacatgcaatagagtgggaaagtgacccaatgagaatcaattggagggggagagattggagagaggaaagataatcaacagtgagaagttcagagaaattagtttaaatgtgggaagcaatttcatcatcaggagatagcaatctatggcctgagggtgaaaatagacttgctacctgatttttgtaaataaagttttattggaacacatccatgtttattcacttaatgtattgtctccagatgctttggggctacaatttgcagtgacagagctgagttgggggcatctggtctttagtggtctgcaaaattgaagatacctattatctagccctttacagaaaaaagcttaaggttaaggagtcttggatcaaataacaggaagaataagattttcactgaaattagtgtaagtgtagataagtttctatattttggggacatctcttgtgctaacttctaatttctttacatatagacttgtggaataaatgagtacatagctaagaatattataaatgatgagaaaaaaagcaaaattccaaaacgggctacatgggaatatttatgtttaggttctcctcatagctcacaattaatttgtatatgcaattacaaactctatggactacggtcattctagaggaatattatttaagtgcagtatatgtcaatttgaaataataagttttcacgagatatgtgtattttgttttgatttttttggtatgtaaaaaccacttgtctaaagcagtttacttctgaattattttgcattttaaaagtatccagtgaatcatttttttcctatttataaatgactgattaaaataaataagacttggtgtttttccatgagacgtatttgaaaattaataaaattgttaaacttaggattaaggaaaataacattaagaatttatttggtcttctgagacattttgtaactatcctattttaaattaaatttagtacttttacaaaatctcgtttcaattaccaactcatatgaattccaaccaaatactgacttttaaaattattgaaacatccaccaaacagtacagagttattatgttcatccttcttctctggacttcatgaatctctgtcagccaaggaatgtcggtttgtttactgggtatcccatttttcctcccacacctcataggtgtgacttggatttcctcatcctcatcttggaaataggtccccccttttagggtgtttgtaagaattatatgaaacagtaagaacaaagaaatcactaggctagacgtctttcatgtgccatctaataaatttctgagaaagtttttttattgatgcttatgaaaattttattataaacttgcttttaaaaagaaatcttttatattgggttattaaattgttctaggtacatttctctaaatcttctattattttctctctgaccttccattgatttaggagaatttgccataacagtgcttatttctttttcttccttcttgattttatgagaaaggttctattgtgtggattataatagccaagacagaaagtctcaggtgaagtacaggaaaaaataaaggaataaaatataaaataagttagaaagtaaatgtatacccaaagatataaatggtagaattagagaaattagaggaagaaaacacacacacacacacacacacacacacatataagttggtatactatatatgtatgtgaatatgtatatatgtataaacacatatgaaatatgaataggaatattgggaagacatatatttgaaactatgaatattttatgccatattactccattttcaaggtattgattggttaaaacatattttatataaaacctgaaattggaagcacaaatgaccttaaataagaaattaaaattaccccaaacaatttagtaaatatttattatctgtgtactgtgctgttaggcacggggtcagtgtccccgccttcctacaatgcaagggttagtgtaatatctaaaggtatgtgacttgaaaaacgatgaagcaaaatgactggaaccttcattgagagtatgttttagagagacagagtagagttttagagagacatctgattttatagtagaaagtttattttaaactcacatataagcttttacagatacatttttatagtaaaatctcagctgctagaaaattagagtatatcagtatatgagattgctgtaggtttcgtggcactaacaaaaacacaaggatggatgaactaaaaaatgagtttgtttctctttcagacttacttctcttaaatgttgtgtagatgggagtgatggaggccttgtaggaagtctctgctcattcagggatccatagtcctgttgcccagtttttcgatcatcccctgggacgctgtcttcgtagtcacggttgaggatagctcaccagcttcatgtgtgtatcacgaccttcaggagggaggacgaagaagagagcatatctatgcccatttacgtcttaatgacgaagttggatgcgttatatccaactggccaatacttggttacatgccacatctaactgcaagggaaagtgggaactgtagtgacatttctagatagccaaattgtcccctaaactttctaatactacataaagggtgaagaaagatacatattggaggatgagcaatctttgccagagccatttttttaatgtaggaattaagattaatgtttttcaaaaaaaggcaggggttgcaatcctagtgtctgataaaacagactttagaccaacaaagatcaaaagagacaaagaaggccattacataatggtaaagggatcaattcaacaagaagagctaactatcctaaatatatatgcacccaattcaggagcacccagattcataaagcaagtccttatagacctacaaagagacttagactcccacacgttaataatgggagactttaacaccccactgacaacattagacagatcagtgagacagaatgtcaacaaggatatccaagaattgaactcagctctgcaacaagcggacctcatagacatctacagaactctccacccctaatcaacagattatacattcttctcagcaccacatcacacttattccaaaattgaccacatagttggaagttaaagcacccctcagcaaatgtaaaagaacagaaattataacaaagtgtctctcagaccacagttcaatcaaactagaactctggattaagaaactcactcaaaaccactcaactacatggaaactgaacaacctgctgctgaatgactactgggtacataacgaaatgaaggcagaaataaagatgttctttgaaaccaatgagaacaaagacacaacataccagaatctgtgggacacatttaaagcagtgtgtagagggaaatttatagcactgaatgcccacaagagaaagcaggaaagatctaaaattgacaccctaacataacaattaaaagaactagagaagcaagagcaaacacattcaaaagctagcagaaggcaagaaataactaagatcagagcccaactgaaggaaatagagacacaaaaagccctttaaaaaatcaatgaatctaggagctggttatgatcaacaaaattgatagatcgctagcaagactaataagaaaagagagaagaatcaaatagatgcaataaaaaataataaaggggatatcaccaccgatcccacagaaattcaaactaccatcagagaaaactgtaaacacctctacgcaaataaactagaaaatctagaaggaatggataaattcgtggacacatacaccctcccaagactaaaccaggaagttgaatccctgaatagaccaataacaggctctgaaattgaggcaataattaatagcctaccaaccaaaaaaagtccaggaccagatggattcacagccgaattctaccagaggtacaaggaagagctggtaccattccttctgaaactattccaatgaatagaaaaagagggaatcctccctaactcattttatgaggcaagcatcatcctgataccaaagcctggcagagacaaaacaaaaaaaagagaattttagaccaatatccttgatgaacattgatgcaaaaatcctcaataaaatactggcaatccgaatccagcagcacatcaaaaagcttatccaccattatcaagtgggcttcatccctgggatgcagggctggttcaacacacacaaatcaataaatataatgcagcatataaacagaaccaaagatagaaaccacatgattatctccatagatgcagaaaaggcctttgacaaaattcaacaaccttcatgctaaaaactctcaataaattaggtattgatgggacgtatcttaaaataataagagctatgtatgacaaacccacagccactatcatattgaatgggcaaaaactggaagcattccctttgaaaactggcacaagacagggatgccctctctcaccactcctattcaacatagtgttggaagttccggccagggcaatcaggcagaagaaggaaataaagggtattcaattaggaaaagaggaagtcaaattgtccctgtttgcagatgacatgattgtatatctagaaaaccccattgtctcagcccaaaatctacttaagctgataagcaacttcagcaaagtctcaggatacaaatcaatgtgcaaaaatcacaagcattcttatacaccaataacagacagaggcaaatcatgagtgaactccattcacaattgcttcaaagagaataaaatacctaggaatccaacttgcaagggatgtgaaggacctcttcaaggagaactacaaaccactgctcaccaaaatacaagaggacacaaacaaatggaagaacattctatgctcatggataggaagaatcaatattgtgaaaatggccatactgcccaaggtaatttatagattcaatgccatccccatcaagctaccaatgactttctacacggaattggaaaaaactactttaaagttcatatggaaccaaaaaagagcccacattgccaggtcaatcctaagccaaaagaacaaagctggaggtatcacactacctgattttaaactatactacaaggctacagtaaccaaaacagcatggtactggtatcagaatagagatatagaccaatggaacagaacaaagccctcagaaataatgccacatatctactactatctgatctttgacaaacctgagaaaaacaagcaatggggaaaggattccctatttaataaatggtgctgggaaaactggctagccatatgtagaaagctgaaactggatcccttccttacacattatacaaaaatgaattcaagatggatcaaagacttaaatgttagacctaaaaccataaaaacctagaagaaaacctaggcaatacctttcaggacataggcatgggtaaggacttcatgtccaaaacaccaaaagcaatggcaacaagagtcaaaattgacaaatgggatctaattaaaccaaggagcttctgcaaagcaaaagaaactaccatcatagtgaacaggcaacctacagaatgggagaaaatttttacaatctaatcatctggcaaagggctaatatccagaatctacaaagaagtcaaacaaatttacaagaaaaaaacaaccctatcaaaaagtgggcaaaggatatgaacagacacttctcaaaaaaggcattgatgcagccaacagacacatgaaaaaaatgctcatcatcactggccatcagagaaatgcaaatcaaaaccacaatgagataccattgcacatagttagaatggtgaacaataaaaagtcaggaaacaacaggtgctggagaggatgtggagaaataagagcacttttacactgttgatgggattgtaaactagttcaaccattgtggaagagagtgtgcaattcctcaaggatctagaactagaaataccatttgacccagccatcccattttatcccattacagtaatatacccattactgggtatattcccaaaggattaaaaatcatgctgctataaagacagatgcacacgtatgtttattgcggcactattcacaatagcaaagacttggaaccaacccaaatgtccatcgatgatagactggattaagaaaatgtggcacatatacaccatgaaatactatgcagccataaaacaggatgagttcatgtcctttgtagggacatggatgaagctggagaccatcattctcagcaagctaacgcaaggacaaaaaaccaaataccacatgttctcactcatgggtgggaattgaacaatgagaacccttggacacaggaaggggaacatcacacactgggtcccgtagtggggtggggggaggggggagggatagtattaggagatatacctgatgttaaatgacgagttaatgggtgtagcacaccatcatggcacatgtatacatatgtaacaaacctgaacgttgtgcacatgtaccctagtatttaaagtataaaaaaaaagattaatgtttttggctctagaaccttttgtttaataggctatagaatgagatttttaaaaactaaaataccccatatgtgtacgtatgatacccatttttgtcttcttaactggagcatcggaggcacaatgtagcatttctgtgagtggttctgcaatagtgaagaatgttaaatttgctgacatttaacatcaaaggcaaatcatagggattaacagaaggcgcagagttcgaatggtggacttgacacatgccttcttttagaaagaatttgttagctttattttttgctcagcttcttctgacttctttttctgtttatgtttttaaaaaactgttaaaattatgttttaaatttttgtggctacgtagtaggtgtatgtatttatggggtacatgagatgttttgatacagacatgcagtgtgaaataaggacatcatggataatggaggatttaccgggtctgtactaccatctgggctgtgtcccattgctgtctttctggtattctggtatcttcctcagtgtgatatcagtgtctgtgacttgcgtgcattatttagacttgacatttgatttcctactcagcaacgtaatgaagacgaggtattttcctagtagcttccaaaccattgattgaatttgtggaaattaagaaaaaatacactttgacttatttttaagaagttacgtgagggccggacaccgtggctcacacctgtaatcccagcactttgggaggctgaggtgggcggatgacctgaggtcaggagtttgagaccagcctggccaacgtgttgaaaccctgtctctattaaaaatataaaaattagcccggtgtggtggcttgtgcctgtaatcccagctactcgggaggctgaggcaggagaatggcttgaacccagaagggagaggctgcagtgagccgagatcccaccattgcactccagcctgggcaggaagagcaatactcaatctcaaaaaaacagaaaaaaaaaaagttatattatatttttttaaaagtgctgttgcttagactcttaattcattttcttcatttaaagagattgatcatattgggataaagacgtgttttggaatccaaacaacctggttttaagtcccagaaccaccagttacctttgtgacctttggcaagtcatctaatttttctatttccatttcctcatcctactaatttctatcaccctgatctgttgtagtgaaaaatgatataatgcgtgttaagtgattagcaaattgactgacactaagtactcaataaataatggcagctgttgttattgctgttgtatatgcggtagtagttgtatttgttgttgattgttgccctaacagcaggccatgatttttcctaaatcctcattagggcttaactttgaactcaatttcaggccctatctatattaaaaattacctatttaatagtgtcattaggttgaatgtcatgtacagtgttgcatgatggattaatttctcataaatcacttcagtaatcatttttatgctttgaatagtaccttggtttacgtgttatatctgtgagaaaacacagcggaaatgtgtcaagaatatttccaggtactaatcctggttgttcagaaatgctcttctgttatttagtgaaagaaccgcttggttatccctctgtaatcctttatcttggaaataatcttttactgaggggtaaaaagattatagaatacaccaaaaaattcaccatccatgcattgacttagactccatgaaaaagaagtatgatacatttaaatgaactgagaatgataaaatttgcaaatgttcttgaagcatttatgcattcaagaccaataaaactgtttttgatccaggttaacagtcgtatcatactttaaggctgaatttagataaattgccaaaatccattttatcagtgatataaaactgctcagtgatagactgtgccctctcatagtgtcccagctattttttctaagagctttgtggtttgctgggctgctggtttcactacctacatgtagccacttgattacttatctcagtttgaattgcccaaatcatgcttccagaaacacacagagctcattcacctgtttccccataaaaatcatttatcatttcaatgaactttggcccccaaacacaggcattgcagagcatttcttgggatctagaatgtgcttagcattttatatgcactatctcatctaatctttccagcagccttacgtacgtatatttttatttttcttgttttatagatggggtaactgagatgcagagaggttaaatacccaagatcagacagatagtaaactggattttaaaatatatttatatattcagaagtatcaaggctattgctgtatacttcattagaaccatttctagtcagagaaattctacgagtagaaattatgactagaaattgtctccagaaatgagtgtctagagatttttctagacattgctggactaaaacagtcatttatcatccctgatttttttacctttctcctttctgctctttcaccttttttttttttttttttttttttaaaagagacggagtcttgctgttttgcccaggccggagtgcagtggcgctttctcggctcactgcaagctccgcctcccgggttcacgcctttctcctcctacctcagcctcccgagtaactgggactacaggcgccgccaccgcgcccggctaattttttgtatttttagtagagacggggtttaaccatgttagcgaagatggtctcgatctcctgacctcgtgatccgcctgcctcagcctcccaaagtgctgggattacaggtctgagccaccgcacccggcctcttccaccttttttaatgagcgatgtcttcaaggaacataggtgacaatatctaatacttcctaaatctaacaggcagtaattaagcctctgaagtctgtggataacgttgaataaatttgagtgtactcaattttgggggaaaaaaaaaaaacaaaaacagaatcgtttcatccattcactgtcatgcctctcatcgtaatcattatttgcccaatgtactgaagagaaacataaactactgtgataaagacaaaataggattgaagcataggaaaaataattagttccagttgatgatactggcatcttcattcatgaaacgattggggtctatctttcttataaatagatctataaagaacaaaaaccaactttcctagaaaatctcttcatttgatgccatgacatgtatgaagtgatctccaatcttaggtacaatgtaaaattctgtgatgataaaaacatattttggggtgctgaaacaaagcataagccactttttatatctttatttccaaattctcagattaaacatcgttttattttaaaatgtcttttattccaaggtctctatggaaaatatacaaatgtagaattcaggcaaatttcttttttcgtcggtttgcttagtctgaaattctagagccatttccaattttgttttacaaactgcagaaaaaagtttaatctcaccttagaacatatatacatatacatatcaaaataaacccatatgcacatctgaaacaaaaattgagacaataattgttagtattatataagtgacacagactactatttttctgtttaattttaaaatattcctagtcataacctactaacatgattttatgaaccatgaatggattctgacttacaatttgaaaaacaatagtctatctagacaaataattactcagatcttaaattcaaattttgattataattctgtatatatatagttgaattgatggatataaatataaaattttgcatagcttattcagatttgaatttatctttaagaaggctgtctttgaaatgtttttgttttatgcacatcctcagacaaaatatttaggttcagaatttgagtactagatgtcatgtccttgagtataagtatacaccttttaatattttcttccaaaattcaatcctgtgtaaatatcaataaatcataaagtgtttaatattttgattcaaattgcacagtgtaaagtattgtgttacttgagtattagtgctgtttacaatgcttcgtttggagaagattatttgaactcaagatagttaatgatttttaagaactcttaaatacgagctaggttaaggttcagatttcaaaaagagttaaataatgtttgctcttacacatttttgggggcgtattttcgacaataattttccatctcctgaaacctgaacagtgacttaagaaggtaatcttggggcaatttatgcttcaaaacacttcttatatatgcagaggaatttgataataattacagccgtaacatactttatttagttgttatacaaggtcactctgtgaagtgcattatgcactctttaattcttaccacaatcttattatggaagtattattgttcccattttacagaagcagaaactaaggcttatgcagggctaggtaactcccaaagtcacaagattccctttctttctatatcatcaatttcagcataagtggttggttcatataggaacataacaggagtaggaaaggatatgatagggtttcttggtcgtttgtattttcttgaaaaaattgccttcttgctgcatttgaagcagggtctggttcagataggaagcattatctcccagggctgccagcaaccttgtttactcagttatagacataacacacttacgccatattctttgaatcttactaaacttactgtgagctcaccagacttctgtgcttctagggcattgaaaatgctatatgcaaataggacagatacacatattataccacctgtctcctctgcgcatgtgcatccttcattgcacataggacttcacttctaaaacacaaattcaaaaataaaattatttacaatttcaggatagtatcagcagataatagaggcatgtgtttcttctgcgctcagggccctgtgcaactgctcaggttgcacaaacgtgaagctggttccacctgcgcacatctctcaggctgcctttatatcattttcccccttaatgctgactttgatagttattattaatagtatttagagacggaagagatacaccatggaagttgttctaacccctaagaccttcagaaattgccttactgttagacaagggttccatgcaaatagccctttcagtgcacttaccctctttgatatgatgaagttcggtgattttgacttaccaggatgacctttctctgccacttttatagaaactggaaaaagagtgcatcatttgatgaaaatgtcattgcaataactgccactatgccttgtcatctcgaaggacttaacagttggggaaatttaaaatattgaattttcaaaatttgagcatttatcagaagagcacaagtaagttggtgctggcagcttagtgggttaattcccagaactgagaaggacaggaaatgtagcacatacacaccaggggaaagccaccaaaggttgaattttctctgggtgagattatgaaatcccccaaacagcttctgttgttctacactgctttttgattcctttacaaaaccctgtttgttagggggccccgtgcttgcttgcaatatttgtggaatgcagaagattcttctacaaatatttctccaatatttgtttgttctgctcacctccgtaaatagtatgcctatgtccttgacctcagcaaagtccctcttgagcatgttctcaggatttttgaagcccggcgacctgcaaggagtacactcctcccaaagcaaaacctcctgcaaacttagtagtttactcaaatttttgcccttgataaatgcctttaggttaaagcagcagacatgtagtttatcccaagaagcctctcctgtcacttgagtgtatggttcctatagcatgcaaatctctgcaaacatatggccaggtttacagctcatgtaaactaccccgtctctattacttggcttcagatggggagaagttagagccacgcagagcgctccagcctctccagaggaagcctttctcaccagatttttctaatcgacctccttgcttgctcttacacacctttaagctagatattggattaagggttgtgagaccaattttgtgatcacttcttagcaattttttaacaggtaccctggatcttctctttagaattatggatgcttcgtacactttgctcttggctttagggtccagacggaaattccaagacaaccatttgcattctcacttaatatcctgctaattaaattgggtaaagcatacttcatattttagttcttctaagataatgtcttactatttaaatcgtggccttctggaaataaaggctaaatcacagaagtcattatgctgttagaaattttagatgggtgggtgaggtattttttttctttctaaattttgccttcctttcccctacctccttgttttcttactgatgcctttactggtctgtaaatatttggaaatatttcattacctagggcctctcaggaagagatatttcctttaatgccattgcagaggtatgtaaatataattctgataatgtatatgtaagttattataaataagaaatgaggaaagttcctacagatcaatatttatagcatttaaaaagcaacatgaggtgatatactaatttactccttccagtaatctagaagagctttaatacaatattaatttggtgtggattttgaccgctatttgaaaattgatgtatgcatgaggaagttaaaatgaaaactccctattgtctgtatctgctgttcctgtgtttgataatgccagtggacagtcctagcattttaaatatttcattcgattcatcatttaatgtactggaacaatctgcaaagacattaattgtgtaacacccaatttattttattgtgcagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggtaaactaaaacgttaatttacaaaacaaaacatatgacttgttataatggcaagtcatcctttttcctcaattactctcttacatccttgtattttggaaatttagttactatgatgtgcttgggattccaacagtcagattttgaagttttcttttggagagcaaccattgaaggcatttctacctgatcggccaacaggaatacgaaagcccaacttctttctcttgtgtcaaggcagtgctgaggcattacttacattcctgagttgatgtatggtattgggcttaacttctctcagtgggagacttttcctgagatgatacactcgtttggcttctttcccttccctgtcctttttcctccatcttcaactcccttgcggaacttcctgggagctcttccttaataaatcacttgcactgaagtccttatctcggggcctgcttctgaagaacttgacttaagataattttccttaattcatattaaaagtggttttgggattctgcaaatacaaattaaattccttttactgggaatataaatctaaatgggccacaagtttaaaactgcaaacaaataaaactcaaaaccacaccgatttacctagagttctaattacaattgttaacttccttctttgtcaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaagtaagtccttatttgtttttaattaagaagactaacaagttttggaagcttgtgattattttgatgtggtttgatggttaagttacgattctcagtttgttcccaaggcacacagctttctttcaagggagactggttggattttcatagaaataacattttggttttcacttttgtaactaaaagagcagatgttagatagatgcactgttatctacagaactatgttttaagatttgccaaaattctgtcatagttattattttctaggttttcctccaaacattaaaatgtcactataaaaggcacagaagcatgcacaggagattgtgtacataaaatcacctattagctatagttgacacgaaacttctcttctgaagaaaaagcccttgaaaatattaaagagttactcatctatatatggaaatcctcttgaaaaacattattcaaacgttttgggaaattcttattaaaatacagtatggctatgaattatcttaagaatatatattgacttaataaaaaagaggatttgagacatttctgaaaaatgacatatttcttataaaggtaacaagcagatctcatcattctggatatgtgttttgatttatattgttaggtgtgtatattcatgtaaagcctatcaagacaagatagatttatttttaaatgaaaagaaatgaagtgccaactgtggatttgaatacattaagtgaaaaaaattgtccaaatgccttaagtttatttaactattatttatgaagttcaaaagcgttaaaaaaaaaaaaggaccaaggaaactcattagatatgctagaaggattggtattccagtactaaattatagtgtgaaattatggaggggaaaaacacatttttaagctcaggccttttgaaagaataaataaggtacatgtaagatagaggtttcataactatatatgtattccaagccaggagatactaatctatgcatattgatattattcgcctgctgtgatcgtggtgatgattgtcactacccctagatgtgagaggtacaataatcatattataactgttgagtctgcccactccccagtgtttaccaggtccactaatttactccatctattatcgatattaagatataagctgccttctgtggtcatatgccaacattcttcaggttagaacttctatttgcagtgatctgtggaacttaaagcaacctcaaacaaaattagaaagttttgaaaatccaaccacctctttactgtccttgccataatagccaccagtgtcttctcctttgtgcactctaggtttccatcctctcctggaggctaaatgctctcatttttcttacactccccattttcaataaaactaacaatatggcattaattattcatactaatcagttaattaattgctgtgtgaaattgagttgcaagaaaatatgaattcctcctggaattaaaattgcaactttttctttgcttatctgaaacataaaaaaagtcttttatctgtgattctaacatttaaaaagatgttcattcaaaaattccccccttcaagggatgtctgccattaagtgaaggatgacagacacctagacttctgtgcgtgtaatttcctcatccccatcccactagagaatggaaatgctaaaatggcagtattaccacctagctgagattgacataaaaaattagtttgtccttagggaagattcaagagcttttgtacgtgttacagcttttagaataattattaagaaggcaaggagagccttctagctggtatagcttttgctaaaacatctcacagagtttttaaaatgagacacgtacatgtaaccacttctatcacatagacttttctggaaaattccttaaaaatgaatatacaaagcattatttgagcaacacaaattcagaaataatatgagagtttataaataacagtcttccttgccactttgactatgtatgtgttcgtgcataaaacctattaaattctaatgtgataagccattatgtaagctttgctgaacctgatttttgaaagattttgtgagaggaaacaaaaaacgtgattatgaaaagagggtattgtcattatttttaaaaaactaatctaggttttacttaatgcttcaaataaattataacctgttcagtttccattatcatggtcatgagaatggattatctccaatgattagcttcaacttggagcattacctattttttttctaaatatatgattacttcagagtagaagattactagtaaacaaaaatggattcatcgatacttcttttctctctctacctaagacagggtttggatagatccagtcggaagccattatttcctgcctaagccttggtttagcgattagagaaatgataattaacatttgtctagtcatattaagtatatccaaagctatgctataatttctaagttgatataacaaaagttaaaaacttcttgtaaatacagataagcttatcactaaaatctatgaacatttacacttagcaattattaatcctatctaccaacatacttactattaggttgctgcaaaagtaatcatgtttttttccattgtaagtaatgggaaaaactgtaattacttttgtaccaacctaatagcaacatcaaattatatttgatatatagtcattgtgagatatatatatatatatatatatatatatacgtataaaatacacatatatctctctatatgaacaaatattaatggaatacattatcaaaaacaattaatggcactggagactcaataatgatcatacaaggtctggccccagatctcatgaaacatattctgtagaggctggcagccaagaaaaaaaagaacacaagaaaaataccggataggaatatagtttttgaagagattaaaatgtaatgtgatagagaatggttgaggggaggctactttagactttgtgatccaggtaagactttgaaggttggtaccatttagtttgagatttgaatgacaagaaggtaccactatttgcagatcacaaggaagtgtggttcacggattaggaacagctaatgcaaaggcccaaaaatagggacagtttggcttgctggaggaaccaaaaggccagggggactgtagagttgcagggtggtaagttagatggctgaggtctgagatggggttgaaatataggtaggagactgattacatattgtagtgtcagtcagggctttgaataagggctttgaattctagactaagtgcaagacaaagccatcagattttatgtaggtgagagataggtcaagaaaacctatcaggaaggccactggaggaagagaggacagttattaggccagtgaagttggccagttaagacacagtagtgtcttagaccagctggtagttgtgataaaagtatactttactatcttagccatttagttattttaaaaaccacttctctgtttagttttagttcctatttttttttccttttgacagtaaaagtgctttttcctttggaaatagactgcttcaatttgtgcccacagttactattattcaagttgcatctaggaaataatatttatcccataaaccatcaacaattatgcaaaacaagaaatattaaaaatacaaagataatagcgtgccctgatttctgccttacataaaatcctctccagtttgcctaaggaataagggcttgctttctcaaacacttatttatgtgaactggggcaatatacttttcttttctgttctctactttatagttttgtaaaacagcaatagtgtcatgaggctgacatacctctgaaagatactagatgagatagggtataaaaagttagtttgtgaatgcaaaattattataaaatgtgaagaaagataactgtgataaataagatgatgagctgtcagttaactattttaccataccatgtcactttttatatgtaatttgatattttctatatgaagtattatataattttatatataattatatttcatatattttgtataataacttatatataattttttaacttttaaaaaaattttgcagggaatgaggtcttgttatgtttcccaggctagtctcaagctcctggcctcaagtgatcctctcccaccttggcctcccaaagtactagtattacagacctgagctaccaaacctgaccctcatagatgttttttactttttttctccagccttttctaattgcctcagtcatttttttttcccaaagagtatagctgtggttattttgtatggggataagggagcatgagcaggatgattagaaatacatttgcagttattttttcacaatggcaacatttaaaaatatgcttacaaaggaatgtcaggaaagataaccatacagatacttcctcctttctttctccttcataaccacactctcatttgattctttccttgctattgtattttccctccaattctgttgcttttatggacataaatttctgatgaggtaaaagctaatacaataaagaagtttattaacacatctccagtcacaaatgagtttggcacgtgccgatactggtcaattacaaaactttaccaatgtttatatgatttaaatgagaaaactaagtgccattcctttcataatgtagtgtttaaaacaagagaatattgatgtggttttgttagaaccccttaagaggagtaagccaatgattttttttttaatgctgtggaatacacttgggatggtaggaggtaaggaattcggaagaaaaacacacaacttccaactgtggaagtgcaagaagacaactggcacagggaaaacagaagattttcttctctatgaataaactaattaatttgattgaaaaatgcaacctgcagagagcaaaaaagatttactgacatttttataaggactcaaagttaagcacagcaagttccatcaacttttctgataattgtagttaggacatgcaggcagaaactaaaacttctgtgacggtaagggaaaaaaatgaaagcaagtcaggaggccaagtgaagttgtgttttttggtttatatcagcaggaggagagatatgaatagtatctgggtagatacacaagccataatatggaaaataattgtgaatcaccatcaatgctttgactggacagaaaaatacatctaacaaatatggctcatctctttttttttcccccaagtgtctatttgactctggaaataagatggcatatgtgagagtggatagagaaaaggaggtgctgaacaaatgagtgggttattttctcccaagtgcagtgaagtttgcgtatgtgaatatatgaatgaatagatgaacaactaaattaagttattcaggtaattccaatcttggaattgaattcgttgcagtaaatactttggaggtgcacaatctcaaactcctaattgtgattttatttcacaatttggtaagttcattgatttttctgttttacttcttccagtaatgttaagcaatagtaacttgcagatcaaggtggtgtaggaccagtagcatcagcgtcacctgagaacttgttaaaaatgcagactctcagctctcattctgatatatacagaatcagaattgtgcagtttagcaatatcccaggtgatccctgatcagtttaagtttgagaagcactgatctaactgaaattaagacagagtagaaatctcaacttctttgtaaacctctacttagatatcttctgttcctatttttctatcaagtgacgtgggccaaatattttaattactttctcaggagctctaaaaatggtgctgatatttcattcagtcctcatatgttgatatcataccccatgggtgattaagcagtagcaagattctggtgcaataatatataacagacaatatatgagtgttgatgagtattgataattaagctattggactaataagaagtaggaattatttatagatgataacgtgacattcggttaggttgcacatggattatggtcataataatttttctgtcaataattaaaaatgtgataatgcagctaaatgtggacatctcttgtactaataatacaatgcatgtgactcatagtttaaattacaggaaagctaaatttctggaattcacagaaatgagagagccgtatcttcaaaaacaatgctttctcacaaagataaataatgctgatatggtttggctcatcttgaattgtagttctcataatccccatgtgttgtgggagggacctggtggaaggtaattgaatcatgggagtgtaaccctcatgctgttctcatgatagtgagtgagttctcacaagatctgatggttttataaggggcctttccccttttgcttggcccttcttcctgctgccatgtgaagaaggacatgtttgcttccccttccatcatgattttttctgaggcctccccagccatgccgaactgtgagtcaattaaacttgttttctttataaattatccagtctctattatgtctttaattagcagcgtgagaacagactagtacagtacattggtaccgcagagagtggggtgctgctataaagatacccgaacacgtggaagtgactttggaactgggtaacagccaggggttggaacaattcaaattaaactaatagactatctcagagagcagatttaatagaagttgacattttaatcttagtacaaaaattcccaatcagaaatatcaaaactatgtcttgttcataattaagttatactacttatacattgaagaaatatttattgagtgtgtagtatgtgccaggcactgtgccagatgctatgtagtggcaaaatttttgaagttgagagtgagcttctatttccacataaatgaatagaatttcagagtgtcaacattacctattcttactagagataatttaaacagtcttccaaacgtgatatattcatatttgtccttggctcctgatgacatctgccaatttctttattttctttaaaagcatttaatcaggaagattgatttgagggttgccataatgtatttgccacaagaatctttttctttttctttttcttttttttttgagacagagtctccctgtctcccaggctggagtgcagtggcgctatctcggctcactgcaagctccgccccccgggttcacgccattctcctggttcagcctccccagtagttgggactacaggtgcccgccaccacgctcggctaactttttgtatttttagtagagacggggtttcaccatgttattcaggatggtctcgacctcctgacctcgtgatccacctgccttagcctcctcagcctcagtgctgggattacaggcatgagccaccacgcctggccaagaatcttttgcatccagccacgcagcttctttatgttattgttactaaactgaatttatgttttcaaaatgaaaataaatgtgtttgcatttgaactttaatgttgcctcggatagttgaaaaatattaataattaaactgttcagctatatggatggaggacaaaaatggatcaggatttgaaaacaatgacacattttcgattttctcatagaattcagtataaaaacaatactatttctcacattccattaagtaggaaaataaatgttagtgcatgtttaattttgtgaaaaactggaacattttccttcatttctagttgttggatggggaactttatattaggttctttctgaactatttactgtgaggttgtaatttaaagtttgacctccaagatcaggttgcagggtgcagtataataactatggcaattagtgggaatttttgaaaatgatacatgacatgctctccttggcttctttcctagcccaagatgtcagcatacttcgtgttgggaaagaaggtgctgtaaagaggagaatgaacacattagttttagggggataaaaactgtataattttgtcagaccttgcctcacttcattctccaatggaaactactatattagtgcctaagatttatacacaccgtgacaccatgcagtgtcaggctttgcagctgagtctagtaaggaataccagaatttggaggaaagcagatctagttactgaggcaagtaggtaaactaggccagtagggtttctacagcttcacagatgctgagggtacccattcagaaagttagcatgagaactagaggacaatagcgatggatgtacttgtggtaaaggtgatgagatagtgaaaacagtgacagctgaagtcttacacatttgagggggtaattggttctgtttggattctggctttaaagcttatatttcacaggccacttattgaactttgataaacgttataaatcttgggagttgaaaaatactaatatgcttcctatggaccattcattattgccatgcaacaacaacaaaaaactatgtgcatatgtttgtacatgcactactcaagcttttcttttaaatgaatgttgcttttctatattaaaacatgtttgccatttcttggattataatatatcatgatttctgattcctatatttaatgatacaccatacattttaaaaatatctagtcattttatatggtcaccatatatttgagggaaaatgagtctcgaagtttattgtggaggaggtggagaaaaatcgccaaacagaagcctccagtaattatccctgttgcaggaacatcaaattgaacaactgtccacactagaaaagcaccttcataagagtgaaaaattaggtgcatgatcgtagtacctggtttttgggttgtatcacagaaagaggcacagaagagggtagtaaaggcaatattctatcacctataccagctctccctcatccatggcagcagtcacatggcatgaagagagagtctatgtgcttgcagaagggagattgcagtgattataggactttgcattgaaaatcagtgctgccctgtcacagtggaaaccgacaaagaacagaactcagccaaatcccgcagagggagcatttagatgaaccctagacagggaagaatcatccatcccagtgtttggaacctgagttccggcaagccttgtcatcatggattagagtgctctgtggttctaaataaacttcaaaggtagtctaggccacaaggactgcagttcctttgcaagtcctggtgctgtgccgggctcagagtcagtggacttgggatacatacaacctagtgagacatccgctggggcagctaagggactgcttgtgcttcccttcccccaaccccaggcagcacagctcacagctccaggaaagactccttccttccgcttatgaagaagagaggagacaagaaagagaactttgtcttgctgcttggataccagctcagacatacaataggatagggcaccaggcagagtcttgaggtccccattccaggccctagctcacagataacatttctgaacacaccctgggccagaagagagcctgtcaccttgaagagaaggaccccgtcctggcagaattcatgacatgctgaccaaagggacctagggccctgaataatcagcagctgtagccaggcagtacttgctgtgggtattgggtgagactcagagctgtgatggtttcaggtgtgacccagtacattcccagctgtggtggctacagggagagaatccttctgcttcaggaaaggagaggtgagagtaaaggggactttggcttgcagcttgggttccagtttgaccacagtggggcagagcatcaagtgggctcctagggtccctgattccagagtttggctcctggattccattttcttactgccctgaagggagagactcaggactgacagcattcaccacaggctggccaaagtggccttggcccttgagtgaacattggacctcagacagtactctctttggttcagtagtcgtcgtggccatgaggagagacatctctgtttgtggaaaggggagagaagagagggaaggactttatcttttgggtggggtgccagcttagccacagtagaatagagcaccaggtagatttcttaggttcttgagttgatatagtttggacatgtgtgcctgctcaaatctcacgttgaattgtagtaatctgcagtgtttgaggtagggcctagtgggagctcattggatcatgggggcaaatttttcataattggttgctactgtccttgcaatagtgagtaaattcttgcaagatctggttgtttaaaagcgtggcaccctccctctcactcttgctcctgctgtggccatgtgatgtacctgttcctccttcaccttctgccataattgtaagtttcctgaggcctccccagcagctgagcagatgccagcatcatatttcctgtacagcctgtagaactgtgagccaattaagcgtcttttctttataaattactcagtctcaggtatttcttgatagcaatgcgagagtggcctagtacagaaaattgttaccaagaagtggggctttgctgtcaagatacttgaaaatgtagaagctgctttgaaattgggtaacagacagaagttggatgagtttggagggctcagaagaagacagatgagggaaaatttggaatgtcttagagactggttaaatgattgttaccaaagtgctgatactgatatgcacagtgaagtccaagctgtcgaggtctcagatggaaagaatgaacttattggcaactggagtaaatgacatgtttgttatcccttagcaaagaagttggctgtattatgtccatgctctagatatctgtgaaagtttgaacttgagagtgatgatctcgtgtgtctgacggaatgaatttctaagcagcaaaatgttcaagacgttgtgtggccacttctaacaacctactctctgatgcaggagcaaagaaataagatggaatatttattattttattttattgtactttaagttctgagatacatgtgcagaacgtgcaggttttttacatatttatacatgtatatttaaaaggaaagcagaccataaaggttttcaaaatttgcaacatggatatgtggtagaaaataaaagcccattttcaggagaactcaagaaggcttctgagcaaccacttgctagaaaaatttgtatacctacaaagaaggcaagtgctgatagccaagacaatggggaaaaaggcctggaaggcatttcagagatctaaaaggcagcccctcccattatagatccggaggcctaagaggacagaatggtttcctgggccaggcccagggtcccagctgccctgttcaacctcgtacactgtgcccccgccccaacccctcccccccgcacccagcgtcctggccactgtagctccagctgtggctcagagtggcccaagtacagcttgggccacagctccagcgggtacaagccataagcctgcaggtgcacagagtgcaagagttgaggcttgggaacatccatctagattttagaggttgtatggaaaagcctgggtttccaggcagaagcctgctccaggggcagaaccctcacagagaacttctcctggggcaatgcagagggaaaatgtgggctttgatcccccacacgtagtccccactggggcattgcctagtggacctgtaagaagagggccactgtcctccagactccagaatggtagatccactgacagcttgacccttgtatctggaaatgaaacacacactcagcaccagaccataagagcagctttggaagctgaaccctagaaagccacaaagttggagtctgcccaaggccttgggagcacaccactcccaccagtttaccctggatgtaggacatggagtcaaagcagataattttggagttttaagatttaatgactaccctgctgggtttcagacttgcatgagacctttcttttgaccaatttcacccttttggaataggagtgttgactcaatgcttataatcccattgtatcttggaagtaactaattggtttttgattttacgggctcataggtagaagaaacttaccttgtctcagatgagactccggacttttgagttaattctggaataagtaaagaccttgggggactgtttggaagacatgattgtatgtttaaatgtgagaaggacttgagatttgggaggggccaggatggaatagtatggtttggatgtatgttcttgcccagatctcacattgaattacaatcctcactgtcagaggtggggcctgggtgggagccgaatgaatcatggcgttgaatttctcatgaatggtttagcactatcctcttagtgctgttttcatgatagtgggtgaattcttgtcagatccagttggttaaaagtgtgtggtaccctcccactcacctcttccctggccgtgtgacatgactgctcctccttcgcaatttgccatgattgtaaatctcctgaggcctccgcagaagcagagcagatgccagcatcatgtctcagggacaacctgcagaaccatgagccatttaagcctcttttcttcataaattacccagtatcagatatttctttatagcattgtgagaatggcctaatacatgaccccaggccctggcttacatataggatcttgcaaacccaccagggaaaaattgctaccctgaagtgaaaaacacaagcttcattggatttgccacctgccgattgtagagtccttgggccctgagtgaatgtaggtgatagccagtcagtggtcagtgtgggccttgatcaagacccagtgttgtactggctttaggagtgacccaacacaatcctagtcgtggtagctacaggggtgcttgtgtcacctctcctttagctccaggcagctcatcacagagagagactctctttgttgaggggaaggaaagagaaaaagattatctaccaggtaatacaggggattttcctgaatcttcccaaagatcaccaaggcagtacgtttaacagtctgcaagagtcacagcattactgggcttgggtgcaccccagtgcatatatggctgcagtgaccaaaggaataaatcacaacacccaagaacctttaaatacctggaaagccctcctgagaagtatggatacaaacaagccgatactgcaaagactacaataaataccaaagtcttcaatgcccagacattgatgaacatccggaagcatcaagaccatccaagaaaacatgatctcaccaactgaactaaataaggcatcgctgaccaatcttggagagacagatatgtgacctttcagacagagaattccaaatggctgatttgaggatgctcaataaaatccaagatagtacagagaaggaattcagaatcctacacataaatttaacaaagggattgaaataaaaagaatcgaacaaaaattctggagttgaaagatttaactgacatactgaagaatgcgtcagagacgagtaacagaagaattgatcaagcaggagaaagaattagcttgaagacaagctatttgtaaatacagtcagaggagacaaaaaagtcctaaaaagtttattgaagagggtaataacacagaacttcccccacctagagagagagattaaaattcaagtacaagaagataatagaacaccaaggagatataatataaataagactacctcagggcatttaaaaatcaaacttccaaaggtcaaggataaagaaaagatcttaaaagcggtaatcatataaaaaaaaaaatcacatagaaatagctccagtatgtctggcagcacaattttcagtggaaaacttccaggccaggagagtggcatgatacatttaaagtgctgaaggaaaagacttttattctagaatagtatatctatgaaaatcctcttcatacttgaaggagaaatgaagactttctaagacaaagaaaagctgacagatttcattaacaccaaaccttttctacaagaaatggtaaagggcgttcttcaatcttaaagaaaaggatgttaatgagcaatgagtcatcatctgaagtaacaaaactcactggtgatagtaaggtttgttactattctgttacaaagagaatattataacactgtgattatgatgtctcaactacccatatcttgagtaaaaagactaaaagacgaacctatcaaaaataactgcaacaacttttcaagacatagacactataataagatataaatagaaacaacaaaaagagtggggggatgaagttaaagtgtagcattttttttttttttagttttctctttgcttatttgtttatgcaaccagtgttgtcatgaatttcaaataatggattataacttattctttacaaacctcatagttaccacaaatcaaataatgtactcaggtacataaaaattaataagaatgtataacatatgaccagagaaaattactttcattaatagtaagacaggaaggaaagagagaatgaagagaaggccacaaaacaaccagaaaggaaatagcaaaatgggaagtgtttaagtccttaacgtaccaatgataacatggaatgtaaattgactaaactatccaatctaaatacattgagtgacagaatggataaaagaatatacaagacacaataatctgttacttacaagaaacacacttgaccaataaagataaagatagactgaaaataaagggatggaacaagtattccatgccaatcgaaaccaaaaaagaacaggattagctattcttttatcagacaaaataggtttcaagacaaaaactataaaaagggacaacgccggtcattgtagaatgataaaggggtcaattcagcaagaggacataacaattgtaaataaatatgtacccaacattggaacacccagacgtataaatcaaatattattagagttagagagatagaccccaaaacagtaatagccggtgatttcaattccccattttcagcagtggccagatagatcatccagacataaaatcaacaaagaaacatcagacttattatgcagtgtagaccaatttgaactaatagatatttacagaacattttatccaacagctgcagagtacatattcttcttctcagcacatggataattttcaaggacaagccatatgttctgccacgaaacaagtcttagaaaattcaaaaatcaaaataacataaattagcttttctgatcacaactgaatatatcaagatatcagtaggaagaattttggaaactatagagacacatggaaattaaacaatatgctcttgaattatcagtgggtcaaagaagaagttaagaaggaaactatagaatttcttgaaacgaatgaaaaaggaaacgcaatgtaaccaaaacctatgggaagcagtgaaagcagtactatgaggaaagtttataggtataaatacctacatcaaaaaagcagaagaactttcaaataattgaatgatacaccttaaagagctagaaaagaaggagcaaaccaaacccaaaattagtatgagaaaataaatattacagtaaggaacagagctgaaatacattaaagtacaacaaaatgatacaaaagatcaacaaaacaaaaagaaggtttttttgaaagggttgacaaaaatgacaagtcttaagcttgactaagaaagaatgagatccagtcacttacaacaacatggatggaactggaggacgttatgttgattaaaataagcccggcacagaaaaacaaactttgcatgttctcacttacttgtgagagcttaaaaaaaaaaaaaaaaaaaaaaaaaaaaaaaaaaaaattaaaacaactgaactcatggagatagagactagaatgatggttaccagaggatgggaatgctagtgggtcgggggcagtggggatcattaatgggtacaaaaatatagttagattgaatgaatgtgatgtagtatttgatagcacgacaggatgattactgtcaaacataatttgttgtacgttttaaaataacaaaaagtataattggaatgtttgtcacataaagaaatgataagtgctcgaggtgatggataccctattaaccctaatgtcatattatgcctgtatgcctgtatgaatatgtctcttgtatcccataaatataaacacatactatatacccaaaaaaataaaaatttaaaaaatagggtattgtggtttctatcattaaagtaaacatcatgctaagaacaattgtctcaagagtaacaactgtaattttcgttttggtgaaaataataaaattattaatgacaatctctgtataaaattccaccaaatgaacttctgttttctatttttttaatatttataatcagtgccataaatgactttataatagatataaagttaatctctaaaaagttaattttagttcaggcaatattgcatgattgtgaagcaggccccggagccaaactacctgagttcccactttgtcaccttcccttgtttgcgttttgacccaagtaagcctttgtttccccacctgtaaattggggctaatatcagttgctgaatcaataggattaattacaataatacctctttttttctgacacacaattattattttgtatttaaaaattatatttaaaagccccaaattctacaagatcaaaattactctttagtaagtcttcttttttatttgtaatttctgggggtacataatagatattttagtacttgtggaagtcatttataaataagtaaacgcatgtttgtgcatcctgatcctttgtctccatgttacctctgtgcatctggttcatgttaaccctaacaagtcatgttgtctggatacagctttccaggtatttgccacttgtgaggacccaagggctaaagtaaaaattatggctgtgtcctggggcgggggggggggcggggaagaggcacaatcgttctcaaccctggatgttcattcgaattacctggttggatagttttttacagaaccaatacctgggctccattcccagatattctgattgaattgttggggaatggggctgggacgtcattttgaaaagttctctcagtgattctaatcaattagtacctttttatattaaggcattatttatataaattccactaattcacctatctgtgatagtttgaataaaagccggacttaaacattacctcaattaataactttctgttttttaacctatcttggatttcttttcttttttctctccctcttttattattattattatactttaatttctaggatgcatgtgcacaactcgcaggtttgatacataggtatacatgtgccatgttggtttgctgcacccatcagctcatttacattaggtatttctcctaatgctattccttccccagcccccaatacctttcttaatagagaatgaaacaaaagctgaaacaaagttgattttaaaaattacttatttaagcagatgacagcattctagaagcatctagttgcatataaagaattgttaagctaaaaccaaaactaatctatctataagaaccaccttgctagaatttttgagccatcgttttgttatttttatctatttttttaagacggagttttgttctttcacccaggctggagtgaagtggtgtgatctcagctcactgcaacctctgtccccccgggttcaagtgattctcctgcctcagcctcctgagtagccgggattaaaaagtgcttgccaccacgcccagctaatttttgtatttttagtagagatggggtttctattggccaggctggtcttgaactcctgacctcaggtgatccagccacctcggcctcccaaaatgctgggattacaggcctgagccactgtgcccagcctgagccatcattttgaataagtaaataaatcaattccaattttcatcagtacaattttagtttctaaatggcgtgcatttaaaagtaaaaacatgcattaaaaattaagtttctctaatttgtactggtatctttcccttaaatcatattatacaggttttatttctgacttaaatcatgtaattgtattttacatgtaagacatgtcaattgaacatcactggtagttcttttctaatctagactttcattataatacattacctccttttattaggtgtatttttttaaattgaggattgcatatatgccagtaactgtgaattctagggaattgggcctgagagcctgtcttcctaaagagctcacacctcttggtaatttgtaagttttaattgtagtcctctaggttttataaagtctatccatttatgcctttattagttagtgcctagcatatgattatgttttcataatatatgtttatacattttataatgtatttccataaagcacaaaaaatgctattaggaccatcaaatacaggctgaaattaatgaaaacatgtactattttgcatttataaatttgtatatggaaaatgaaaattttaaaaaatgctattaatgtttattgctagattgctaaacttaggatgtcattcctcatagacattggaggacaaaataaattggtatggataagtacttgcaaataaggattcacggatattggtaatctaattatctgtcggtttatagctgtgctgtccaatattgcagccgctagctatgtgtaggtaaattataattattataattaaatatagttaaaaattcagtttctgagccttactagccatacatatttcaagtgttcattattcccacctgactagtgtccattatatatgtatacctatagtgcacacatagaatatttacatcattttagtaagttctggacaacactggttaaagaataattgccttcctacattctttcttttttgttttttgaaacggcgtttcactctgtcactcaggctggagtctaatggtgcgaactcagctcactgcaacctccgcctcccgggttcaagcaattgtcctgcctcagcctcctgagtagctgggactacaggcatgtgccaccactcccggctaatttttgtatttttagtggagatggggtttcaccatgttggccaggatgctttcgaactcctgaccttgtgatccgccgcctcagcctcccaaagtgatgagattacaggcgtgagccatcgcacccagccgccttcctacattctaacagagtttctgtaaagcaaagctggcattcccattgaattcctttatgttcatacagatacgttttcatgtccgggggtgggatgacagctctcgagtaaaatcatttgaaaaatactacgtcttagaatgccatttactgcaaatgacaaaaaggccaactcaaagtgacttataccattgctccttaaaatgtgattaatggatccgaagcattgatatcccttgggcagttgttagaaatgcagaatctcaggccccaacccaggcctactgacttagaatgcatagtttgacactctccaggtgattcatatgtacattaaagtttgagaaacactgggcacaatcataaggatgtctgttatctaacaatatatcaaaaatgtcgttgacgctagagaccattaggtctgtaactctatgttgccaaagttccaagttcttacaacttatctgttttgctagcccctctctattctcagatgatctgaacgattggaagtttaccgtagcagttcctagtatcatgtcctgatatgcttttgcctatacctactgtcaggaccaactcctgccctatactactttattctaattccactccctcggctctctattgccagtcatatatgtatactccattcaccttttgcttttactttcccgtctaaatgacgacttgaaggatataaaatgaaacctggaaaaatgcaaacattttttcctatctgtgcatggtagatttttattttgtgactttgacaatttttccaaatttatttacatctttagaatgttagctggaaataagaaactcctgtctcattttcatcatgttttaaattgaactatatgaagccattttcatcaacaaagaaattgaaatatcagaaatttcatatgatctaatacaatattttgcccatgaaaaaaataaaatagtgcacagtcttgggtcacacagggtttgtgatttctatactggcttcacatgccactgtgccagctctttaacctaccactatcctcagaaataaaataacagtagctaggtgcggtggctcacgcctgtaatcccagaactttgggaggtcgaggcaggaggatagctggagaccaggagttcaagactagcctgggcaacatagggagaccacatctatacaaaaagagttaaaaatttgccagggaaggtggtgcacctgtagtctcagctactcaggaggctgaggcaggaggatcatttgggcctgggaggtcaaggcttcagtgagttatgattgtgtcactgtactcgagcctgggtaacagaatgagaccctgtctcaaaaaaaaaaaaaaaaatactagtattataaatctttaccttggcaaggttatgttaaaaaaagttgaataaatgttagccagtgtattttacaactaatattaatgacattttaacccagaggttaacctccccactccctgaagtcacccctttatttaaaccatctttgggaaaaaggacatttgtgtcatgaaggctgttaaactcaccttctgatatcagtgcctccttcaattttgcttcttcctctggttcagccttgcaatggaccactactcacttccttgctaatcacccagaaaactctggcctataattcacctgcactttactgatgctcttttcacaggcctcagtgaaggaaggaagcgtcctcttcattactagttatttcaatctttagagtttttcacatatcagtactgtaataaagcccttccttactttactgaagggcatacttgggcattctgagtctgataccctttgatacttccctgccagtgtcacataaatctatatcttctgagttttagcagtagtaactaatagatcgaacacataccttaagtagactagcagtggttttcaaataaataatattcttacctggaatgttgtcattcaaagtgtgatccatgacccagcaacattggtttcacctggaagctggttagaactgaattcttcgacccaaccccgtgaatttaaatcagaatcaccaggtgggctgtatccatatttaagtttgagaagctgtgatcaagaccccggggggcaccaaatccaaatgcctattgtagaagccagaaacataacataaggaagtgagatgagttgcgtataaaaaaggatagggagtgatgaggactacagcaaactggagagcttatactttgtatatgaagtataattggatgcgaagtataattggatgtgaagtataattgatactcaattttgtcctataggaaggaaggtttagggttgctgaatcctattaaatatgatcaagagtggtcagatttgatatttgtagctaatatctcaaattttaactactggcaaaaatttcaatttattttcaattagtatgagaccaaatccagcatatggactactatttgctaatatctagtcaaggcctgtagtaaggaaaagaaatattttctcaattaaaacatctcagaatcctttccaacaatgggatgaatgctttttgttttcgtgcttattagtatcacacctccacaatccttaggttcttctgttttcaaacttgttctgaggttaatttcatgcttcagacacatgaaatcctgctttttggagcctcaggtagaacccattctttggcagttggcagtcacacttctctctgtaagtggaggtgaagtcaggaagagaatgtaaaagtctcatgtcaaaataattcatagtaatctcctggggattggcagttgtcctcctattaatgttaatatcttggtctctgcagaatttgggtgagttgtgtttgtagaataaagttacctagagcagtaattttcaagtgtgagtatgcatcagtcacctggaagtcctgttaaaatacacatttctagacctcatcccagagtttctgattcagtaagtgtgagtcttgcacacacttctagcaagttttgaatttgcacttctagcaagtttctaggggatgggctgatgctgttggtccagggtccagtaaccacactttcagaaccactaatgaagagagaaaaagcagggctctatttggctgggagacattgatgtgactgtaccagtcattaaaatattgagccatcccgtttgcacacacccagccattctggtccctaccccaaaaatccccaaccagatgtttctgtatcccacttataaagagaaaacacctggctgggttcggggactcgcgcctataatcccagcacttttgggaggccaaggggagaggattgcttgagctaaggagttgaagaccagcctgggcaacataatgagaccttgtctctattaagagaaaaaaaaaaaaagaagataaaacacttatgtgtacatctcttcttattggtcaatctctgagtccaagtttgtaaaatgaaaccacgatagaacatgaaagattactgggtgttcaaatttcagatttggggcagagctcaagaaatctctgtggacccacagattaaggtaggctatgatactgtacaaccatcctgcaccttgtgcgatcaagctgcactggatttccggttcctctgtgatgtgacagggcctttcacaggtctttctttccgtctagaaagagtttataccttctttttcactacttctgacttcagtcttcacagttgtccagtactgcactaaaggcccccctttacagactcaattcaattgctctcatttcatagtatgatcacattataaccaactaatggcctgttgagctatatgtattatctgtggccctcacccgccatccatataaactccaagatagcaaggggctgtgttggtcttccttgcctctccatccgtagtatccaggtactcaataattgtatatttcgtaaattaatgaatgaatttttcaagtctcaactcttaggctgtgtgttctgcgaggacactgttcccaatgactgcaggtcaatttgtatcctctccttactccctcaggaatgtatataaatctaattataatggatttcttatattctaattatttttgtatttatgtctctaatagtctctaagctacttgaaattgaagataggtattttgtccattcctaacaaatatgagtttcctgcatagatatgaaactcagtaaagatttgttgaaggaaatgtctgtccaaaagcaaaaagtaaatgatgctttcaaatactagcaactttcagtttttgcttccacttaaatggatatctcatctctgttgtttctcataaaaataaaatgtctactttttgtgtttgataaatgaaagtttattctcataacttctgattgcaatgttcctcatggtaaatgtgtctctaaaatgttaaaagtcaataaatagtgcaatctaaattattgtaaacactctcaaaaggaatatgaaatgcatattggaagaaagctctgataacaaccccaatacttcggaccagctatggagccattatcttttatattttattttactggtttacttcccctgtttccctgtaattttatatgaagagtgtgagtggtatgtaacattacatacaggttccatgttggggtttaaatagcctggcattagtgtatgaggataaagatgctgatggaattttgtatccttttgttttaaatacacttatactaatttaagtattttgatagttactctgtttagcagattcatttcacttttctccttcttgctctgttcaaagaggatgaagtctagattttctgttacccaggttcctcttggcctttggttgctaaagtacttcagccaatgggaggcactggcaagagggtgaaagcagagattgtggtacttttctcttcctcttctgtttcttactgtggagtggctggaattgtgttcctcttaaactacagctactgttggacagctcttgttccatgtctctaattctcactgagctccggcaacagctctcttccttttttcttccagttccggggatgctaggtcagttgtctttgttgttaggtcctggctccttcactatcgtttattatttttcccccgacccttcacataaatgtgtaagtagtctactgagcgaaacatatttgagtgtgttctatctttcctgccaatagtatgcagcatccacacacacactcaacagacccaacttttatattttattgtttgaaatgctatcaatttctaaacattgctttttaaaccctactttaaattgacagataaaattgtatattcatcatgtacaacgtgatgcttctgagtaaatatatattgtggaacagttgaatctagctaattaacatatgcattaccttacatatttatcatttttatggtgggaatatttaacgtcctctctctctacatttttcaagagtatattttcattagctgtagtcaccatgctgtaaaatacatcacttgaatattttgactgtgactatatatcccttgaaaagtatctccatacctcccccttccccataaccacctcagcctctggtaaccactattcattccctacttctgtgggatcagctcttttagattccacatataagtgaaattaggcagtggttttctttctttactggcttatttcacttaacataatatcctccaggttcatccatgttgttgcaaatgacagtattttattcttttttatggctgaatagtattccattgtatatatgtataccacattttctttatccgttcatatgttggtggatatttggattgattccatatcttggccatgaatagtgctgcaataaaaatggtagtgcagatatttctttgacatactgatttcatttcctttgtatatataattcatagtgggattttgtatcatattgtagttttgttgttcatatttcaaggagccttcatactgttttccatgatgcctgtactgattgccattcccatttacagtgtgtaaaggttttcttttttttaattagtaatttttaacttttgcaggtacgtaatacatgcctttttcctaaatcgttatcaacatttatctttttttgttttggatagtagccatgctaacaaaagtgaggtgataatctcttcttttttcttttgacaaagatatcgttaattactattatattttaacttttaggtgcaagggtacatgtgcagttttgttacatgggtaaacttgtgtcatggaagtttattgtacagattatttcatcaccaggtataagcttagtactcattagttattttttcctaattctttccttctgccaccctccaaactccaataggccccatgtctgttgtttccctctatgtgcccatgtgttctcatcatttagctcccacttataagtgagaacgtggtgtatttggttttctgtttctgcgttattttgctaaggataatggcctccagcttcatctacgtttctgcaaagaacataatcttactctttttcatggccgcatagtattccatggtatgtgtttaccacattttctttatccagtttaccactgataagcatttaggttgattgtctttgtgattgtgaatagtgctgccacgaacatatgtgtgcatgtgtctttttggtagaatgatttatattcctttaagtgtatacacaataataggattgctgggtccaatggtagttctgttttgaggtctttgtggaatcaccacactgttttcaacaatagttgaaataatttacactcccacaaacagtgtataagtgttcccttttctttgcaagtaagctgatacctcattgtggttttaatttgcatttcccagatgattagtgctgttgagcattttttcatatctgtgttatccatttgtcccttttatgataaatgtctattttggtcttttgcctatttttaatcaggttatttgttttcttgctatggagttggttgaatttcttccatatttttatatgaacccccatcagatatatagtttgcaaatatttttctcattctattggatatctctttactctgttaatttttaattttaattttaatttttttgctgtgcagaaatttttagtttggtataagtcctcagtctatttttgcttttgttgcttgtgcttttacagtcatattcaaaagttattgcccaaataattgtgatgaagcttgtcctctatgttttctactaatagattgagagttttgagtcttaaatttaagtttttaatccatttcaaattggtttttgtatgtggcaagggataagggtctaatttcattcttctgcatgtagattcttacttttcctggtagcatttgctgaagagggtgtcctgtcctcacggtgtgttcttgacacccatgtccaaaatcagttgaatgcaaatgcattaatttattcctgggttctctattatgttccactgatcagtttttatgctaatacaatgctgtcttggttactatggcagaatttcttctagttgcgtactttgaccttagtgggaaataaaaaacatccttccaaagaaccatattattagtgtttccatattgatcgagtatcttctgttttttttattggttaacactatcatatatgggtatactaagagactcctggcaaatgcccatagttttctaatgtagtactacttgccccgcattgtattgggtgaactcagttgaccatttgtgcttaggttctgtatggtaacccctttctctgtctgtggattcagcagcatgaggagccaaacatgaacagcggtcatctcaacttctagtttaaagaaatcatttttgagtttcttataactcaaaatgttgaagaggtagttcaaaaaaaagttgaagaggtagttcacagataaggaacagaagtcacaaggtggagagagatggataaattaatattaggttaatacagatgagataattatatatagaagtatttatgggtgagtacacactcacacatccacttctttatgtcaacccagaggtcctgtaagctacaacaccctagaagcaaggagcatacctagcaacaggatcttgggtttcagtaacattctttaaagaaaaaaaaaaaaaaaaaaaaaaaaaggaaccagaacactgtggagaaacagctgattctaacactaggaaagggaatatagaaaatgagcctggaacatttggtagtgccagatagtaagaacatgctaaactccacggtctcgctctaaacaaaaaacactgatgggatgtgtcaaagaagccaactaagagacttcccaatgtccaaagctggaactatttgagcaaaaatccaaagcaaaaactagtattggatttagcccaaagtatcaaataactatacatgagtccatgctatgtaaataaataatttcataaataaatggaggaatagagacaaatctccaatgcagaaaaaactccaaaaacttatgtaacttctctgccctcacggagagggaatgtaactccccactccacaggggctgtgtatagtgactttcttattaaaaaacagtgtgaaaagagggggaaagagtaactttatagtggataaacatgacacctattactttagccaggtggtcacatttaacattgataagtcacgttgagggtatatatgctttataaaatgtgcttaaaatggcccattacttctgtggtctttcaaaaaccccagtttaattatgaggaaaaaaaatcagacaaatccccactgagaggcatactacaaaataccagcctggccagcacttttaaaaactgccagaaaaattctgagaaactgtcatagccaaaagcagattaaggaaacaggacaattgagtgtaatatggaatccttggagagatactgaaatacaaaaaatagtttaaggaaatcagaatataataatagtctccagctaatgcacaaatattggttcattaattgtaagagatgttccataataacataagatgttaataaaacgggagactgagtgcaagttatatgataactctttgtattataatctcattaatttttcgtgaatctaaaacagccaaaaaattaaatctgttaaaaaacactctcagctatgtgtgcactttgtgtgtttaaatgtgatgattaatggaaacttccagtaaagattttagagtaaaattatgtattcaaaataacatattcctaattcaaattataagatcaatgttcagaatatagttttgaaaaatgctttaaacatgatgtttataaagagtatttcctttaaaataaccatcagcacttctcatttgcatctcaaattttggttgaattaatgaatgaacaataatgtgttttcatcctcaacataaagttgtgtaattaataggcaaaacattatcccatgtccctgatgctggaaatgtaattgagaacgtttaagaacctggttgtagagcttaccgctgggctgtgaacctaggcctttggactttaaattcattacccagcccactattttctatatctttgtggggaaaaagcaccctttctctagtctatttgtgtgtatcaaatgacgtccaaacttaatgggttaaaacaatttataattgcgtcatgatctgaagaccgagaatataagcagggctcagccaggttgtttttatattactagttttatagctgggggtcaccccttgggctgtgctgagctggaagctcacttctaatacagtattttatcctgcagaatcactcctatatggtctctaatgattcggtagtgtagcctggcctcctttacagcatggaatctaggcttcaagagaggaagaaatacaaatgctgccagttcttttatagcctacacttggaattggtgtggtgtcagttatgccacattctgtggtcaaaaaaaaaaacacaagtccagatcatattcacagggatggaaaatagacctcatctcttgaagggaaaagtgacaaagaatttgtggccatctttaaccaccacacatactaaataatgagaatgtaaacgaacaactgccaaaatatactacttagtcaattatcagatgctttgcacttcagttagcatgttcacatttagttgactatgtgaaagtttttagaaatcaggatttgtgaactattataagtctgagaaataatagttccggggtgactgatagtgggctttacttacatccttctcaatgtccaatagatgcccccaaatgcgaacattccatatattataaattctattgttttacattgtgatgttcagtaataagttgctttcaaagaggtcataataggcttctttcaaattttcagtttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtaggtgtatcttatgttgcgtgctttctactagaaagcaaactctgtgtatagtacctatacacagtaacacagatgacatggttgatgggagagaattaaaacttaaagtcagccatattttaaaaattatttttacctaattgtttttgcaatctttgttgcaatggcttgaataagtcccctccaaaattcaggtgattgtattaggagatggaatatttaagggtgaataatccatcagggctcctcccttaagaataggatcaagtcccatataaaagaggcttcacacagtgttctcctatctcttgaccctccaccatgcaccaccatgtgaaaactctgtgaaaaggccctcaccagatgctaacatcttgatcttggatttcccaaactcgagaactgtgaaaaaataaaggtacattcttcctaaattacctcattctcagttatttttgttacagcagcacaaaatggattaagacatttgttgttgtttttttaaaaaatacagcatagctaggcttttcgtatttggaaaagaaatcaaacatatttgtggatgagaacaacgcagggtatgtgatttattaaaaatttgctttcctggaagacagacttcatagggattacttgtaatgcaaatttaaataataaggctacgattttttttaatgtaattttacattcaatttatagtaaattgaagctggccaagcttgatgataaatgagagtctgaagcattgcttttctatagaatatgacattttttaaatgttaatatttccatcttttttcttcagtttacttgtacatttccagttatgctccctcgctgccagaaagcatttttttttgtttctgttattgagacttctacaataatatttcttatccaaaattatgagggtgctttattttaataagtgccataaaatattacaattagctctgagttttattgttgaaataggctcctgctcaattcatgaggaaacacacacacacacaagatcctttgtaattgtcccaggattagggttgccacatttagcagacacaaataaaagaagcctacttaaatgtaaatttcagataaacaacaaataattttcttagtgtgtgtcccaaattgttcattgtttatctgaaattcacattttgctgagtgtcttttattttatctggcaactctacttatgatctgtggtttttggatttatggctttgaataggaatatctgctcctttacctcataccttcgaaatctgccttttgtcaaacttaattctctctttttataatattcagtcatatatagctttacagttcttccatgcaaatgaaagatacatttatttctaagttctagagttttttttaagtttaatgagcttcagttttgaatgacaaatggggccagcccttactattattgacccccaggagtcctctaagatctagcatttaagaagaactgtaactatggtaatccccgtctgctatgccatcaggaaaaaaacatcaactgtattgcaattatgtagaaattgtaactgtgattacttgtcatatagatactaattgagcacctgaagaagaagttaggtacagtgctagttctctaaccgtaccgcttttccgatgtggcacatttgcttctctcgttgacactatatctgccctctttcccttggcctacactggaagttacatgcagaaagtgtctatataaaccaggggtgtccaacccgttggcttccctgggcgacattggaagaattgtcttgggccacacataaaatatactaacactaatgatagctggtgaactaaaagaaataattgaaaaaatattttaagaaagtttacaaatttgtgttgggccacattgaaagccatcctgggtcatggattggacaaggttgatgtacagcaatggcttctctctaccggagggtatttctggtgcagaaccatttcagccagtttgaaggtggacaggaagtggaattagtgccaccagagctgcccttagccaatgaggagtaaaagttgatagagaaatcctgtagaatctttgtcccatagtgggacatttctaaggtatattctccacagtctttcagagattccccagtaagactgagctccaggtatccacagggtaacttcctgaacgtccccgtgctctcataatgccttacgagttcaccctccaaataaaccatttatttgttcacaaatcttttgttcaggatgtgtttttggaggaatctaacccaagacaaacttctcccactagaagccagaattcgagctccagttctaccactaactaaattgtcattttccaaacatcacttaatgtcccaggttctctgtatctttactttggaaataaaagagtgagtttgtttctagtgttccttccagtcacagtttaaatgtgtccaatacttttggaagttgaagtattttagaaaaggccaagattaggccacgtaacactgaacatcagaaggcaggacactgctgctggatgcctggagtgtaaagcgaaatccagggagaagagctccaaaagagcagtagaagaagaatgttagcatagctaagtacggataacctagggcagctatgaaggaagttcttagcttgggacgctgaacagactcttcattaaggtgagacaagctatccaggatcttaatattctgccaggtacctgaaatgttttgtagttttttctgaaagatataatgtgaatgaaatggaaaacgtttgacaaatattgtcataaaatttaaatatattattcattacttgaaagtatgccatttctaatgactatgaaattgccttgaagaaaaaatgtgaaacaaaagaaggcaacaggagtatatgcaagttgattatgtaacattttacctccaggcattatttatttatttaaagggcataaagaggccagaaggcattggttttctggctcagagagtaaggccaactcctacttttaactatttgagcactcttttttttgacagatttgacaatattttttgaaatatttgacagattttttttttataaaaattaagggaaagattcatattcaagtcctgaatattgataatgctcttttgtttcttggcaacaattttggcgagaagaaggtgacttaacatcaaacaatttagcaaagagttgactttatttaaacctgaaacatgtacattatattgtcttttaagactaaaaggagcatacatacagaattaaaggaacactgttttgttagtcttgccacacttcataaaacaaaagaaaataaatgttacttctttgggtaactgagttcaaactaaagccttatttatatagtcgttgaatcgctttgcagctttttttcccaagaattgtaaatcattgaaagtaaggaaatttctccttctgacaacaaaatgcatcagtaaccttagagtccccacaaaagcaactcccatctgctgcatcaccaaacttctaacctaatataatatttatttttagctttgtgtagatagacattaaatccttgtgccatcaccattttttcttaaagatgattgcagatgacaaaattaaagaaaagatacagattttattgctgggaattgatttaaattctgctcagatcagaggtcgcctgctctctctctctcaactggagggcaagattaaaatgtttgcaaatcttgcaagtacactgtgaatattacagatatgcttctgtatattctgtgacaggatcctttgctatcttcatttcaacagcattttattatgaggcaggctagaaattcagacactgtgaaatgtcaggaagataagtcacttttactgaacctggcaattaggtaaggtaaagcaattgatcctatatggtggttactattaaatctagccaaactctttactctgggtaaccaagaaaagttcaattggctgcaccatttgggagaaaccactcatccttcatagacattgctgtagggagagaatttagaggtttgctttagctttgaggcacccaagagtgagtctttctggggagtaaacaaatcgaacctctcattcccctgtgaaaaaatatatcacatataattctagctggtcttttttgtcttaaggggtagaatttattagtgatgttgacaaagaatgaaaggatttccctcgaaggagtggcatgatgctattgaggaggaaaagccttgagctttcattaatagtaaagaagtttgccattttggaggcatttttttcaaaaggaaaatatttaacagtgaaatcttttgtctcctggcacagtgagactgcgatgaagtttaaagctgagtttactagctaggttttccattcttttgagagatttagacttttgtgcatagatgcataaccttggtgacagcatcaacaaagactttacaaattacaagaatttgccgatgtgaatatatactctatattctgacttcagtgaaggttatatgtgaaatactgattaatacaaactaagtagcctcttagaaactcagtcacctatccttttcttgaaggttagttaaaggcagacatttgggttgccaagattgtgaaatatcctcatctggtgacctttaaaatgatctagatgttcatgttacagagaaggattaggtataattctgccaaaggatctgacatttcatttcattccattgcattctattccatatcactgaacaaaccctcattatagcacatgggtgctgtgaagaatgcagaaaccaatcatttacgatgtcttgtactatactgaatgctggaggatttaagcctgatcatggagggtgatcatgagtcttatataaaagactcaggcatttgcagtagtagttctatgagtaacaggaaaccattattcatgagaaattaaactagaaatagcagcaatttaggaaaacttatcttaatatttaagaagatattttttgaggataaataaaagagcagagaaacaggaggccggaaaacatgttaagaggatattgctgaaagtatatagagcctgaatgaaagcaatgacaacaaaaattgtaaacaggtacaaagcattctggatatcaaatcaaaaccaataggactagatttaggatatgaacaaaaagctcaaagtaatagattctgggactgggcaattgggacttgagattggtaattaagaaaataggcagtgaaaaagagaaatgcaatagttggaagaaggataagtgattcagttaagtttgacagtgccataggatcaagtggtgcttttagtggttagcaaactcactctcatatttagcaaggttaaaattacatgttgtttgtttctgctatgaagtttcattttatttcctgtcttttgccctcataagtgcttaatgaaagtttaatggttatgatggtaagggggataaacactataatctgaaaaaatactgtattataaccagagagccagatttcttttgtgttttcagagtgcttagtcaataattgatgctcagtaaatgtttttagaacacatgttctgattatattgactagttttattatccaaatcgtctccatcatggctaactttctgacaagggcatgaaagtttgataatttcaattaaaacgttgggcatacagcaaaaaaaaattcataaagctgtagaaaaatacatctgtaaagtggcttacctggtgatgttatctctggtgtcttcaatctctgactttccttttttccttctatctctgttgcattcccatatgcaaatatcttaatagtgctaaaccattgactatgaaattggtttgagtggtagtattattttgacataaatgattggaagtttatgtaaaaaagaacatcacacttttatagtctacgtagtagtatgtgcatgatattcagttacaatttttaaaatcgaattgagaagacatctaatatcccataagaattctattaacaagcatcatattccaagggtatatttgcacagtaatgctatagattattaaaataataataatataaaatccatgcccatattcttattttacaaatcaagtatttctagctatcagattattatttactttattagaaattactgagtattgattcagtaacattacttagaatgtcacagctttgtttgacagtatatcggtatagctacgaaaattatacctgatcaagactctgtcatcttagaggcactaacattagttattatacttcattactcttgtaatacttcctcatgagaagacactgacctctccaatggtgtttaaaggaaaaaaataagtaccctatttctaatttactgagttagtctcatgtaaaatgtctctctctctctgaaccagtactgtaacaatcaatttcagttctttcgtataggtaatacaaaattaataatgtagataaactaattataaaaaacattttaaaatgcattttagggaaaccttacaagaaagctaagacacacatgataacatgaattttaaggcaataattttccttatcaaatgtatgaccgtatcttataacaaaatgcatgtccgtaaatccaatcccgtgttaaaatataaggttgaatatgatactttttctgaagaatatggagaactatcctgtttaatatttctgttatgaacagaatttctagtggatttctaatactagtagatttctactggtacatctggtagtactctcttattcattggaagtaatgatactgtatcctttaacaattaaatttttatctaagtcatatctagtaagactaaaaaagcactaaactatttttacataatggtctacagttttggcacactgaggatatttaataatggaaatataatgtgattaccaagttattagaaataaatagtgatgctcaaaagggctatttccatgaatctcagtgtaagaatgcaaggataatgtgaatacgtcagaaatgaaagaaaataagcatttcctcaccacctaccaaatctaagcactgtacaagctgaagttaatgtattgtctcatttaactctagtaataagcatgtcttagaagaagttttaaaatagattgagggggtgcatgtgcaggtttgttacatggatatatcgtgtagtggtggagtctgggattttagtatatccataatctgaatagcgaacactatactcaataggtaatttttcacccctcacccccctaccagcctataatcttttgtagtttccagtttatattattccactctagatgtccgtgtgtaccctttgtttagtttcttcttataagcgagaacatgttgcatttaggtttctgtttccaagttacttcacttaggataatggcctatagttcctattcatgtaactgcaaaagacaggatttcatactttcttaggctgtgtagtgttctgtggtgtgtgtgtatatatgtgtgtatatatatgtatgtgtgtgtgtatatatatatatatatatatgcgtatatacacacatatatacatgtgcatatcacattttctttatccaatcatttactgatggacgcttaggttgattctttgctattgtaaatagtgctatgataaacatacaactgcaggtagctttttcatgtaacactttttgttgtttttgttgagtatatacccagtactaggattgcaggatccaatagttgtgttttaagttctttgagaaatctccatactgttttacataatgtttatattaacttacattcccaccaagagtgaataaacattttcttttctccacatccttgccaacacctgttgttgtttgacttttttaatgacaggtatccccttaaaaaaatgagatactgtcatttggaacaatgtggatggaactagagatcgttatgttaagtgaaataagccaggcacagaaagacaaacatctcttatgttctgacttatttgtgggatctaaaaattaaaacaattgaagtcatggaaatagagagtagaaggatggttatcagagactgggaagggtggtggaagggaggtggggatggttattgggtacaaaaattacagttagaaagaatgaaaagacataatatttgatcatatcatacagtaactatggtcaataataacttgtacattttacaataactgtgaaagcatataattaggttgcttgtaagacaaaggacaaatgcttaaggtgatagatactaaattctccatgatgtgattatttcactttgcatgcctgtatcaaaacatctcatgtaccccacaaatacacctactctgtacccacaaatttttaaatgacattgaaaaaaacaaataatagccatactgattggtgtgagatcatatctccttgtggttttaatttgcatttctctgatgattagtgatgttgagcattttctcatatgtttgttggccacttgtatatcttcttttaaaaaatgtctgctaatgtcctttgcctactttttaatggggttatctatttttcttcttgttgagttacttttagattctagatattagttttttgttagatgtatagttcggaattgttttccattctataagttgtctgttcattctgttgattgttttttgtttttttgtttgtttgtttttgctgttcagaagattttaaaattaagttccatttgtctacttttgtttttgagtacttagtcataaattctttgcccaagccagtgtcgagaagagtttttcctaggttttcttttaggatttttatattttcaggtcttacatttaagtctttaatacattttgagttaatttttgtatatggtgatttatgacccagtttcattcttctgcttatgactatccaatatttacagcacaatttactgaataggatgtcctttccccagtgtatatatacatttttttactttgttaaagatgtgttggtcatagatatgtggttttatatctgggttcttaatttggttaaatcaatctatatgtatctgtttttataccagtaccatactgttttggttactgtagccttttagtataatttgaagtcaggtaatgtgatgccttcaactttattcttcttgcttagcattgctttgactatttgggctcttttttgattctctatgtattttactatctttttctaattctgtgaaaaatgatgttggtaatttataaggactgtgttcaatctgtaaattgctttgagcagtgtggttattttaacaatattgatgctcccaatccatgagcagggaaagtttttccatttgtttgtgtcatctatgatttatttcatgggtgttttgtagttctccttgtagacacctttcacttttttgtttaaaggcattcctaggtattttttttttttgtagttgttgtaaatgagattgagttcttgatttggttctcagcttgatcattattggtgtatagaaatgctaccaattttgtacattgatttcatatcctgaaactttactgaagtcatttatcaaatatagggtccttttggaggagtcttaagggttttctagatgtaaaatcctatcatcagtgaagagaaatcatttgactttctttttcccaatttggatgccttttatttctttctcttgcctgattgctctagctaggacttccagtactatgttgaattggagcagtgaaaatgggtatccttgtcttgttgtagttcttgggggaggggggtgctctcaacatgttcctgtttagtatgatgttggctcttggtttgtcatatatgacttttgttattttgagatatgttctttcaatgcctagttgttgagggtctttatcttggggagaggctggattttatcaaatgccttttctgcatctattgagatgatcatatgttttttgtttttaattctttttatgtggtgaatcacatatattgctctgcatatattgcaccacacaaaacatatattgtgttatgtggtgaatcacagatattgctctgcatatatccctgcctacctggcataaagctcacgttattgtcatgtattatctttttgttatgcttttgggtttggtttgctagcattctgttgaggatttttgcatctatgttcatcagggatattggcctgtggtttcctttttgttgtgtccttacctgcctttggtatcatggtgatactggcttcgtagaattaattagggagaatttcctcttgtttgatattttgcaacagttacaataggattggtaccagttctttgcatgtctggtagaattcggctgtgaatacgtctggtcctgagctttattttattgggagatatttattactgattcagtttcactatttgttattggtctgtccaagatttttgcttcttgtggttcaattttgggagttgatatgtatccaggaatttattcatttcctccagattttctaatttgtgtacctagagatgcccatagtagtctgataatctttcgtatttctatggtatcagttgtaacgtcacatctatcatctctgactttgcttatttgattcttctgtttttttcttggttaatctagctagtggcctattaattttgtttatcttttcaaagaaaactctctaatttttttaattttttgtcttttattatctcagtttcatttagttctgctctgatcattgttatttcttatattctgctagctttggtttcggtttgttcttggttttctagttcattgaagtacaatattagtttgctaattttagatctttctatctttttggtgtaggcagttaatgctataaatttccatcttaggactgcttttgctgtatcccagaggtggaggtatgttgtatgtctctttttatttgtttcaaaaagttttaatttcttccttgatttcattgtccaaagatcattcaggagcaggttgtttaatttccatgtatttgtatagatttaaggagtcttcttggtactcatttctagtttttttccactgtggtgcaagaagatgcttgatatgattttgatttttttaaaaatgtgttaagaaccaccttgtggcctagcacattttcaatttttgataatgatccacgtgcagatgagaataatgtacattctgtggtggtagaatagaatgttctgtaagtgtctggcctggaaggatattaatacttgattttacagacaaatagatgtgttcaaagagtttaaggagttgttcaaggtaacttcagtattaattggtagattctgattttaactttgacctgtctgcctttgagaccatttctctccattttgagattccagtgaagcttgactccacctgagatcctagagactagagcagttgcagagaagtgacaaagagatttgaagatgttgtggcatttggattcccaggattgggaatgtctagatagaaggtacagagactgtgtgcatatgagtcttcaaacatagagtaagcagtagtggtagctacacattaaatactcagaatcaaaatgcttaatgaaataattcatcaccattactcctgtagttctttaaaatagaggaaaaagagactataagggaaacaggaatataggcttatgataagaatggcaataccgtctgagcaggaggataatcattggaactgaatttcacaactatattctgttagcagcacaatgcatagcatttcctctgtgctctgcctgaaactttccaccccaactctctcccaataatcttcttttctttttcaataattattttcagtaaaggcattttataattatttattcaatgttattggtttttaatctgattttaattctgtaactatatgcagaatgtatgggtgggtgcatgcatggattgtagaaagagtaggaaaggcaagagaattgagggctaccatttcgtgattagggactgtcctcactccatgacatatgtctgcccatgcaaatttttctgtgataaccatcagatgaggtagtttgaacctacttttattaatgtagtgtaaataaattggaagttcaggtattatttaaggatttaacacttactgtatatttctccagaccttaaaactttgctgtaacttcacttgttttcatgacttttcaaaaatcacattctcttcctgcacttatgatgtctattagaaaggatgatagtcagaatgtattagatgagggtaaaatagattagtattaggttaggtcattgcagtttagtttcaaaactttgatataaatatggctaaatatgaattctttcaactaattagatgctaatatttttggaatttatattgttttccaggcaaaatgcaaaacagttttaccttattcaatcttcttaaccacataaagaaataggcagttttattatcttagttttacaaattaggaagctgaggcttggtgtggttgatgactttctcaaagtcacgtgattggttattgatgcttccaggaattacacatagaaaatctgatttcagatgctacacttttgactacagttttactgtctcctcatagtcatgcacaagttttggtcaatctatttcatcctatgtccttttccatatgtaggagtacattaattgtctactttatttttaaaacagtttcttttcgtatttattgagtccccttcaggctattgagaagcatttagtgtgcttgtatagcctttcaaatctctccattgaaacagtctttcagaacccccatttggtagcttaggagttggcagaaacataaacattcatttctaacaaaaagataaaatcagtgtgttctgatataagaactaataaagatattcaatcacatttaagtaagtgaatatcaaaagcttttctagggtagcctgttgaggaagattatttaaaatattcagcaaatttataacaaagttatataccgtaaatagatcttcatggaaagctagacaatactgtgaccagccaggcttagcaaagtgaatatttcactgcaaataaaatcgaaagtcctttccagatcatatcattcaggccagcaagggatatagagcctagcccagtgtagaggtggtagaaggaatggggcatagaggaaaagagtgaaaaaaataaattacctaccaccccatcatttcccaagaaatcctaacactttctgatctgtacttgaagtttttatttgaaaaaaagtcaattcctgtccagatgtcttgaattaacatgatcattagtatctagggatttttttgttcatgagacagcttttttaagatacttctttcctggatgttagactcaactctattcctagaaccttctgaattcttaatgtcctttgcaaattttatgtttgctacaatttttttctcgttagtctttccttatgtgtgcatttattgagataaactacaaactactgaatatttgtaattaaacatctaaatatattaattttaaagtcatttttggagacaatagattgccttccaattcatgatgaacagcgttctgtgttgtttctaggggtgtgttttgtgtgtgtgtgtgtgtgtgtgtgtgcgtgtgcgtgtttgtgtgtgtgtgacctgcaagtaccggcaattagctgttgggtattcaatgaagtcggaggagtagttaaaaaaaaaaaaaactttacatataggtaacagctgttcttttcctgttctttccatagctgagtctatgctatggccaaaagaaatagacaagtaaaacaaaagcttctcccatcgaatttacaggatacccatccttgtttttgttttctattatactgcctttcgattaattattgctcttcacctttaaacatcaaatcaaaaatttccctagccttacataattccatgtctttatttcctaagtattattttacatgtgttctaagaaagggtaaaatagcatagatctagaataaacactgaagtggctctccagtggtttttctaagccacttttgaaaaccaacttgacatggacaagagccagaagaattcagtatcactgatggcatttaaaagaagtacaagaaaagtcaggtttaaataataaaattgggaacatgtactaagggagtaacaaattttgttaagccctttaactagagacttatttagaagaaatacaattattcacagaggtataacaaaaactgtttgtccaatctaggcattcttaatgttacatctcactgttggccttttctcttgtcataaagaaaaaaatacattatttgacatttgacaacaaacattggtaacatttgtatctaataatggtaatgaaatttaactaggaacatgatagatgtttgaaatctggtaagtgttacaaaagcattcctttaataaaataatgaaaataaatgcataataaagtacctagtatgtgtgtatatatgtgtatgtgtatgtacaatctggaagcttttaataaaggaaaacattttaacaatattatattacaatattttaatttgaaggtattattttctgacagacaaacatttttgtgtacttctctagggatgcatctatatttggaaactatttggctcatatttcaggcttaattagcaaatccaatataaatctccgttgtataaattcatctatgacaaattgaaatccataagaagtcagtatttaaaattgtaattaaatatagccttacaacactttagcatattattttttttaaatactcttgagaattcatttctttccaactggagaaacaggcaggcattctttaccccaatgatcaaggcctttattcatggattcctagtttggcagaacaattgaactttttaactccagctttttatgtctggcgtttctgctacttgtaagaatcagtgtaaaagtaaaccctgaacgttgcatagttcataatctgtattttgctgatattaaggagattagctaatacagttatattcactaatatttatttcgcatttgaagtctgagaaaataggagacgtgcttactgttttaccatagcttttgtcttacagctatttagtgtgctcaaaaaagtcagtttaaccttttttagtttaattcctaattagctgagaaagaagaaatacaattttaaaaagtcatagaggagaagagatactggaaataacattaaatcaaatgtaccttatgcaaatctactccagcactctggactcttcaacgttcttagtcactgtagagagcctttccccactcctttatttccttgtactcaccgtaagtccagagggttcttgtgttagattttaatgctatcatctcacaactctctttagtggtactttacgttagcacttctgccaagcataaaatataaacccttgatcaatatggcaagaatgccatttccaattataaaacaaatagatgaacgaaacaaaatcagaacaactaagtaatggagaatatagtacgtttgatcacatagactttaaaagactcaataagagttggattcattccatggatccaatgtttttcttacacttcttaagtaaaatatattaaaattgtgaaaaagcaatttacatgtaaaaatgaaaactggcattatttacttgtaattttgtaatatatgtaattatatatactcattgaaggacagaaaagaattgactaaattcagaaaaccaacttatgatacactggccaccaaattatcattttaattattatttgaaacattcccggctgacaccttcaaaatgttcccagtcctgtcttatataactcagaaaacacagactcaacatgactgtcaaggacaactctgaattttaatgtttccatttttggcctcatggcaaaaagagttttattaaccattataagctctggaatgtcaaaggcatgataggcagtatagattgcacacacaaaatagatgcatagtcattttattctaaattgcttcacttgaaaatgtagtatgaaaatctagagagacgaagtaaaaagaagtgattttatagtgttctaaaatgttgaggcttcgaaaataagaagcctaggataaaaatgctcatgcatttgagattgtgattcagccatcctaataagttcccttccacctgccatagagtttgaatacctaagagctagactgataggtgctaagcactgttgttttgcaagtagggacagcacgtttgccagaaagtaacgggaaatgtcccaaacttgtttctccactcttgtgttatgtaacaaaatgttctaagaaacaaagtagttgcctagaagtctcaaatagctattcagagaaatcccaataataaatagtgtaacagggtaaggtcttatgggatctggagcacccaggcaacataccttggttctagagcagcctcctttgtttacccctaatttattcctgtgtttacccctgttcatcattacaaaataattgtacatcatgtttttaaaaagattggaaatactgttttgtgacagcctcacttaatagggggaaatgattttttcagagccacatttgtaagttagaaaggcagtatttgaattattctggttttatcctagggttcagttgagaccaagtggttattttctgttgaggttagtgtaattgtgattacaccaaaaatcactaattcttcctattatattgtaatctttgtgcaatcaggaaggaacaaactcatctgtgcatgttttccccaaacccccacatggtaccatttatctgacaaatgtttattgatctttatttgcttgtaatacatagtgagaaggacagagggcatctctgttctagtggactgcctattatagtaagtagagacaaaaggactaagctgatacataagaaattattgagtagtgacaatactatgattaaaaaaatgacagaaatggtgaattactagggagcaacattggatagtttgctcatgaaaagctgctctaggtaggtgacacttacattgagtcctgaatgataaagaaatgatttaaacatctggaagaaaagcaatcctggtagagggaacagcttgacacatttttggaagagagacaaagcaagtcattctgaaacactgtgagggcgagaatggtatacaattagactggtgaggtagtcaggtgctagatcatataagaatttcaggtagagaagttaaattttctttcttagtatgatagaaatctattggtttttataaatcggactgacatctgatttgtagtttgagcggaagggaaaaaacgagtaaaggagctaaaaagtagtgtataggccaggcacagtggctcacgtttgtaatctcagcactttgggaggctgaggtgggtagattacctgaggtcaggagtttgagagcagcctggccaacgtggtgaaatcccgtctcaactgaaaatacaaaaaattagctgggcgtggtggtgtgcacctgtaatctcagctactcgggaggctgaggcaggagaatcccttgaacccggtaggtggagtttgcagtgagccgagatcatgccattggcattccaccctgggtgacacagtgagaatccgtctccaaaatagaaaaaaaaaataaaaaaagtagcacataggtaggagggtaatcaagagaaggtgtcaagaatgagggagtggccaattaggttagtaatcaacatgtcaagtaagacgctataacaaatggttattgaatttaggaacatgaaagttgatggtgtcctttacaaaagatatttcaatgggttagtgggcaaagtgaatagtaggataaatatgtaggcacagtaactataggatacatttgtttttttttttttcagtgaagaggaacacataataggacagtaggaggaccggtttgttggatcaagagtttgttttatttttatggtaatggagaagttcagtagagaagaagagcctgaaaatgccagaagtgctgatagttgtaggaaaaaagtccttgaaagggagaaagggggtgggatgagaaggagaacatcctgctgtacctttcttaacatttgtcttctctagatactttccagttaaattaacaatagaacatataaattttgctgagcgtcatagcagaaaattggcttggaatggttttaggttaataaaaaatgggagtacctgagatgtagcagaaataaatttcaccatttgagagcaaatcatttcaacacacatgtaagaatatcattttaatttcctttaaaacattttatctttcaggtgcttcaagaagatctagaacaagaacaagtcagggtcaattctctcactcacatggtggtggtagttgatgaatctagtggagatcacgcaactgctgctttggaagaacaacttaaggtcagattattttgcttagtaaactaaatatgtcctttaaaagaactataacttgaaaagtattttaaaaatttagaatgcaatttatatattaaaatacttagaatacaatatgtgtacaatatacacacactcataatcagctgaagtgctgtgatttaaagaattccataattctgatacaatagtaactaactgcggatgggtaaaatctaatactttaccagaaaatttcaattaatattaaataaggctgggaagcaggggttgaagggaggttactggttaaaaaaaatttaaatgcagacatttttctaaggcatggagtatttccatttaaaataacaattgaaagcacccatttcatcattagctgacccagtgtgaatagcttttcaatataattcatccaaggtgatgcttgtgtggttaaggcatcttgaaaaacagtccgtagaactcacagatggttgtatggtgggcctatactcttctgtatttgttttctacttgctttcattttcaccttattttctgcctttatttctttggcccaaagacatctactaaatatcggtaaatgtactgattatccctaatttgcttaaactctatctgcatttgtccatgattgcatacccctttaatggctactgccttccagcctcctcttttgtcttcaatcttctttcctcttttgatgttctcattttgcctctatatagctctgtagtgtcatgtgactttaagataatctagactagtatctaaaagggcagcattaaaaggaatcaagtggagagaaagcccttgctataacttttctttgattccatcccatcagttccttcagtcccaaaagaatccatgcttgagttctatactttatttaactattggctggaattgtcgtggaatgctctgcttccatttgactttgaaacagagatgattcttaggttctttgcaagtgatataatcttgtcttacctagtttactttttaaaagcaagaagaagaggacgagaagatggtacagaaggaggagtaaggagaaatcataaagtattaaaagattgataaagtataaaaacataaaaaaatttaacacaaataccctgggtatattataattctagggtagcttcagagactgtggactttaatatgtttaatactggactgagagggattctggtagacgtaattagaagaattacaggaaagagaaacaggtatttggatcccctaaaagaaaaacaatcatcaggactcagagaaggatcttagcaggctttttattagagcagagtctggctatccttaacttattcctcaaaacctattagtgttgagtgcccatctcacgccttctcttccttcgccctggcatccctcatcaccacaattccttcatccattgcactaaaattctgttgaaatgccatccagaggctcaaaaaggatagccagctgtctttggtaaagaggtacagatgggggaaagtaggaagggaagtccccatttagtccaataaggaagagagatgcatacttaacaccctgagttagaactctaaaaatacttccaataggatatatctgcatgtattgatttattctgtaaattctattatgatgatattttaggatttctctaactttaaaatacctttagagtcttctttggaaaaggtttgaagaaaaccaaagacaggtcagaatatatgcttagagtttctgaaagatgacatagcttatgaagtgtaatattctgaaaagtgtgctctccgataattagattctttctctcaaaggttcagcttgtccctcagcaatgttactgcagattagagtcttgtccttaactttagaggcttccaggatgtcagtgcgtagagagtctgtttcataggcagtgatgccagttaacttatttgattgagaaatatttttataaactaaattttataactaaaattggtcatttatatagtcttcagttttagaggtcattaccacatctctttctaagcattccacatcccatttgaatttttttcaacaagtactcgttatgttcttactatgtcccagggattgtgttgggtaaccaggtaagacagttaaaaaaaagaatttgtcactatctaccctggttgcgatgggtaatttgagagcctactgccttccttggaaccctggaacaatggtgactatatctcagtctccctctttgtagtagaatgctaattccttgtcatccatggtcactatgataggcaggtaggcatgggaactgcgctcttggtacatgcaatccagtataaaaatagacattaataaagtatttttaaaaatgagcaaatgttaaagaatggatgcaacttatttataaaggcaaaaaataagcttttgtgacaggaaattactctgacttagactgaactttgaacgcaacagatgattcctgaggaaagttttctttaagctaagatctaaatcatacattggaggaaaatggataaagtgtgcatgtaagtgtcatgggatccttgggtgtcactttgccagccagaaacctctgtggccggcagcacctctgtctgggttttgcttgtgcccgctgggctccttgcacccactcagcctggcaggctgtgcttggcttgcactactggcccggatccccatgcctgccaagggcaagccaggcacagagcagtaagaggtatgtgagcaagcgagcatgaggcctggccactgtgcacagacaggcatgccagctgcagcggaaggcagctacaggcaccagtactggtggcagctccatgtgaggctgtggctggaccagatgtaccacaagtagcttctgctgcaggcaccaatgtctggacaggggatcgcggtggcacctgaaagctcagagacaccaggaaccacagagccccaaggagcatgttacagcatgccacaaccctggcttgaggagccccaaggtctgggctctgcaaaaggccacagctcttctctgtttctcattgcccatagcatggtgagtggggggcatgtttcagccctgtttgtgttacagctctttttgtcctgccattcagcaagtcctgagttcttgtcccatgtccaggaagaatgaggtacatggacaactggagggtgagcaaggtgcagaggagcttcattgagcgagagaacagctctcaggataccacggtgggtagctcctttccacaggcaggtcgtcccagggagtgtgcagctgtgagtagagaggagacccatggtgggtggctcctttatgcaggcaggtcatcctgaagagtcaaggagacacaaagtaggtagctccttcctgcggctggtagtcccaatgtctaagtttgtctgagtctggggtttttatgggctcggaagggaggaggtacattctaattggtccatggacatccatggataggcccagaaaaagcaccataagttctcattctgggccacaaactccacccagaactggcagcccagcccccaggcttcaggccattcttggcttgaaggaggggtttctctgtggatctgctcctttctgcccaggagccagtctgcctcctgccaccatcaacatgccatccatgtagcctaggcagtttataccaaggggtacctgcaggcccacaccgaaccatcctcagtccccactcagcctctctcccatgctcatcagtgcccaaagtccagacgggcgcaaggcagcagggggctggcatgccagcactgtcccgagcacacacataaccagtcaggttgcgacaacacctggtcttggccgcaactttgcttctcccaggagccagtgcggggagcgaggagatgccagggagtgggagcaggcacttcttagtatgtggaggcaggggggcttcccaggcccccaagagcgcaggaatgcccaggtccggagctgtggctgggtggctgcagctgcacctggaagcatggggctcccaccctgccaactcagtagggagcagcgctcctgcttgttcctggcccttggtggctccacacagtgcacagccctggccacgcctcccttgctgcagctggcatctttgcagtggccgctccagacaggctgctgctgccatcataagtgagattggtggaggtgggtagagtttctaggatggataaatggtaaatcaagagagcgtggtttataaaaacttgcatgaaaaaagactataaaaagaccataaagaaagccttttgttcttgggagataactgtttctaataaagaaagaaggagaaacatggttaagcccatagcttatagaagatgctctaatgaaaatgtcttccaaagaaaaagcaaaaccattaaaaccctatttttaggtatgttattctgtacaagttaaaagttgagagccaactatagatgtattgaaggtctgtgtggtcatagaaccaggagaatttctgccatataaaaggcatttgaattattttgttaaaatactttaatattgaagttactgcctaatattttggagaattaaaagtatatgaaaagaatgaggctaggtacagtggctcacacctgtaatcccagcactttggaaggctggggagagaatattgcttgagcccagaagttcaaagattagcctgggcaacatagcaagactatcatatcgtattttgattttcctaataaaaataattataaagaatggataaagacagagtgtattaaggttctctagaaggacagaacccactggatggatggatggatggatagatagatgtatatatgtgtatataaaatatacatttaggagtttatcatggagaattggctcacatgattacaaggtgaagtcccatgatacgccatctgcaagctgggagaagagagaacctagtagcctggtgcagtccaagtccaaaagcctcaagaccagagaagctgacagtgcagctctcagtgtgaggccaaaggccttagagcccctgggaaatcactggtgtaagtcccccagtccaaagactggagaacctggagtcctggagtctgatgtccgagggcaggaggagaggaagccaactgccccgcagggcacaggaagagagtgagtaaacttaccaagcaagctactttatccctgttctcctggctttgttctagtctaactggcagctgattgggtggtgcccacccacattgagggtgggccttcctctcccagtccactggtccacatgtcagccttctttggctacactctcacagacacacccggaagaaacaatacttcatcagtgatctaggcatccctcaattccatgaagttgacacataatattaaccgtcacaacaagtattctattttcaagaaggaaaacctggaaaacacaattttggatcagattattaaacatgaggccatgctcactggtatggtttctcacttatctcatgcagttaataaacatatttattgcctgaaggaataatttttgcagatgagatagttttctaagaactaagctacattcgctaaaattgagtcatgtaaaccaactttatatcagatgacattaaacaatttgtagaaatactttgtggtagtattaagacaaattattttgttagacttattaaattggctgatccaatggaatggaatgaatttgaggtattctgattttcctgaaccttttagcaaagcctctgcgtgatactgtttattggtaaggtgagtctatctttctctatgagtgttcgtgggtgagtctgtgttttaatatattcctttctagtatctgatttacgtgctgaaaattctggggaaggaagccatttgaggatttagctggggctctgtgtaaagtgtgcccctgtaggagtggttaatggaatatttctgctcccatattaacttagaaggtttatagctatgtcctgaggagttagaatatcatatacaaatgttacatcctattgttttaagtcagaaaactcatgtttatagttcgaaatgttgctgctttttaaaaatgcaagtagtataaatcagttgaattagtttgagatacaaagggtctgacttcccatctatagatataaatgtaaatatatataaatgtaagtgtgtaaaaatacatgtaattttgtctatataaaaatatatgtataaatgtgtatatagttaaatttatatacatctctttatgtttctatatatatacatacgtacatctttgtgcatatgtatatatatgtatatacatacatatacataaacataagcacatatgagatagagtgcacatgcttactttgaaacaagcttgatattaaggatgatacagattcttagttaatgcaatcacagactgtgatatagtgtctagattacatgaactaataattatactctatgctgatttgaatacactgtattttacgcccacgattggtactctatcttagcaggattttctcagatggcagcatcctgtgaagaatatttgtagagtgggcgattatttaattaaaaaataactaatcatagggaaatggcacatgaacactattgtgatggtgaaaaaggaaggcactttctctatggtttttcaaaatgtcataatatcagaagcagacagaagttggtaactctggatgtcttctgcccagatctttcctgagtccattttcttctaattatcttctgaacacatccttgaagtccaaacaacacttcaaactcaacaagatgaaacttacctcactgtacattgccttcctttaaacctgctttccttactgaatttcttatttttgtcattgcactggcacttatcatgacacctgtaccagaaacctagagtcatccccaaattcatccctgtcctttcccttatgagccctttgcatgcaatgtcaaaatatttctcaaccttatcttgtatttattatttcatctttgttcttgtcaacatttctcaaggtataggccatatcataagcccccaaagtccttgccttcagtcttaccgctcttccatccaatctccacattgaagtcagtgtgggttcccaagagcctgtttaatcgttctcctttgcttaaaatcctgagtcactttccagattctgatactttggcctacaaggtatttgattacctgactcctaccagtctctatagacttgtctcatgttatctgctttatgtccctcaacctgcatttgattcatacaagctgtttctgataccctgtatgttacgacctctttgcacataccaccgggtttaaacagacgactctgcttcataagatctgctttgataatttcatctatgtatagaaaactcatttcaagttttcctccatgaaattggccactctacctagtgatgactactccctctttgtgccatgtctgtaccctaattgtgtctgtttgggcaccgatcatatacttttgcagttaatattaatgtgctttactcttttattagaatctaaattacatgagatgtgtcttacacattcttgcctgcattgtcagatacaagtaatcagtaattcttgtaagataactgaatgaacctatgaacagacggttggatataattccaagaaagatttttttgacttaaaagggagagctttttgttgtaaggtaattaagaggagaaactctagaaatagacccttcctgctctgttccttatctacagtatacctttgggcaagtcacttaaccatccttggctttagtttccccatctttaatatgaagattgtattagaacctacattatcagatatctgtaaagggtaaaagggtagttgagaagctaaagcatttaaaaatcactgaaatatagtaagcaataataatattagttactattattatcatcatcagcccagagcattcttacaatgcgataagagctgtggaaagtggtgagctgttcttcattaataatatttaacacaaactggaatctcatgttcaagtatgttttaaaagaggtgacatactgagtgggaagttagacttgatagcctccaatgtcccttccaatacaggtggagtgcaagaaaataaaaggaaatactgcccaatcttatctagtagaagcataattctccctcattctgtagagaacttcagctttaaaaagcatgattctcaaaattactttcataagaaaaaacaatctgaatataatggcaaaatataaagaagtcaaatactacattctgccaattattttgaccaacagtgataatttttaaaggtgacaaatctggataagtagacaataagaatgacagacatttaatggtaacatctctttggacattgctgttagtgtcgttaatagttttaacttgtgtaacatgagtatcacacaggttacaaagggaatgtgctatatctcagttacaaagagaatgttaaaataacaaagccacttggaaagaaaatgctatactgtgaaaggtagttgttcagaaagacgataaagtcagatttttctctcatcacctaaatgtcagttaggtaactgaaatttttatagtacatatcttcgggatagtatgagaaagaaaattttatagaatgttagaccctatcaaattaagaaatagaagttatttatgaagaggaatatggttgaaacattttgatgtttcgctctagttcctaattttatatttggtgaattaaatgcatttaaaaaaaactttaaatgtgatggaaataatccacaaagctaagcatcaacatttgttgcccaagaagcaataattataattattagattattatttttcaggagttttacatgctttgtatgtaatgccaaccctatatcacaaatgagaaagccaatgcataatgaagttaaatccaagttcatatagcttgcaggtggcaaggctgacactggtattcagatgtgtgacaactcaacctgagatttctcccaatctctcaaattcatagtagaaatttgctatgtggccttgtgaaaattatgtgatttttttcagttttggtttactaatcagcaacgggggaatacagaaacctatgtaacacagtaatgtattcgtacctgtaaatttaactcattcatgcaaatactatctatctgtataaaatgcaatatctattcatatatatatgaatagatatagcatttgcatgaatgagttaaatttacaagtacaaatatatataatataaacatatatatttatttattttagcacctgtcccactcaattgcattagtacataaatatttttctcttctagaacaacactgttctagaagagaatggtttatatatgtatatagtttatataagcagtatatatatattaacacctgtcacactcgattgcattagtatataaaatttttttcttttctagaacgacactgttcagtaaggaagttgctatacacctttggctattttgagcacttgaattgtgactggtatgcttgaggaactggattttttattttatttacttaaatataaaatggcacatgattcagttattagaaaacttttgagtatgttttgatcagctttgatatgtgcattgttttttcaactgcacattgtatcaagtataaataaatgttgaatattctaatgaaatttgaacatccaaagccaatgtgctgtaagtatacagttaacgctagatttcaatttatgttaatacacggtctgttgtaatacatttggccaatagggtgttaggtagatttgaaagaacacaatgtctggattactcaatctgttttctattctgactttataatttatgagttgaacaataaattctctcatgataaaaattatcaaatgaaactcaaagataacagtgatcataatacccaccatacaaaattacaggggaaatataagcaagtatgctggaacaataatattctttttttttttttttttttttttttttttttgagacggagtcctgctctgtcacccaggctggagtgcagtggcgcgatctcggctcactgtaagctctgcctcccgggttcatgccattctcctacctcagactcccgagtagctgggactgcaggcgcctgccaccacgcctggctaattttttgtattttctgtagagatgggtttcactgtgttagccaggttggtcttgatctcctgacctcgtgatccgccagcctcggcctcccaaagtgctgggattacaggcgtgagccaccacgcccggccacccggccaataatattctttatgaatgcaagtgttaatacatttacaaaaaatttttaagtttattgatacataatatttgtacatacttatagagtacatgtgatattttgttacactgttgtatataattatatagtcttcctactctgctatcgaacattagaacttattccttctatctaagcgtatgtacccattaaacaacctctcttcattccatccacacactcttcccagtctccagtatctatcattctaatctctagctctatgagatccaattttttagctcccacatgtgaatgagaacatgtggtatttgtctttctgtgcctgcttatttaacataatgacctccagttccatttatgttgttgcaaatagctatatttcattcctttttatggccaaataacattgcattatgtatatataacctgttatctgtttatctgttgatggttctgaaaaaaaaatgcaaactttatggtactttttaaattgaagtatcaagcaaaggacataagttataattatagcttaaagacttattacagaagtaacatactatgattccacatccagaaaaagatagtatgttaccagcaaccaggaaacctccatcaagccctatggtatcataaactcttcccatctcctcaaaggtaacatgtatcttgagttataatgctgcaggttagtcttgctatatttttaacttgatgtaaatgaaacttttatatatgcagttttttaactggcttttttcactggatactatatttgtgagattcactatgttgcatatagcattactttattaattttcatcgctggatagaattactttgtatgaatataccacattttacatattctgttcagaaaattggggttgtttccagttcggaagcattacaaataattcatctatcaacataaattgtacgtatatttttgtgtatatatgtaaacttttgtattaggtatttacctaagaatagcatttcttaatcattgggtatatgcatatttagctttcaagatattaacaaagggttttccaaagttgtataaattcatattctcaccagtagtaaatgaaagtacaaactgcttcatatcttcttgaatacttgtttgttaaactttttaatttgagcctttctggtgactttataatgtcatctctcatttttcatttgtatatactgatgaccagtgaggcggaatactatttcagttgttattggccatttaaatgaactcttctctgaaatgcctgtttttctactggattttctatatttctcttactgatttattttagtttaaaatatatatattctgggtattctttgctgtttatattacatttttctttttgaatgggtaccttgccttttcactccgtaatgatatatctcttcataaacagaagtttaaatttaacatagttcacttcaatattttctgttatgtttagtgtacttttgtcctcagtttaaaaataaaactctctactttaaaattctgaagctatggtcctgggttgctatataggaactgtttgttttacctttcgtattacaatccacctattattacaggtatgaggaagggatgaatgtccattttttcccatatagatccaactgaaacaacaagttggcactgtagaatattgaggaaaagatggtcttattgcaaagattttcaataagaccatcctttcctcaatattctgtggtgtcatctttgacgaaaatattagaaataaaatgcctatacgtgcatggatcagtttatggactctaatcagttttatttctctacttgcctgtcctcatgctaattccacattgttttaattactatagcattatgacaagttttaatatatggtaatatttttttgagatggagtttcgctgtttctacccaggctggagtgcagtggcaagatctcagctcaatgcaacatccgcctccctggttcaagcaattctcctgcctcaacctcctgaatagctgggtttgcaggtgcccaccatcatgcctggctaattttttttgtattttgagtagagacagggtttcaccatgttggtcaggttggtcttgaactcctgacctcaggtgatctgccagcctcggcctgccgaagtgttgggattgcaggcgtgagctaccaggcccagcctgtatctggtaatattgtaaaagaaaaaatgcaccagacaaacaggcaagaaagactttattcaagactactgaattatggatcaagactattgccataggagagagagatggaaatcatttctactgaaagaaagacaggagagaatttaagcactgaggagagctagtagaaaaatactggaagatattagggggttaggatggtgattaggcaatctgtgattgttaattggcacttaatgaagttaggctcctactgtcccacagagactgggagataggcgtgctatcattaacaattacatttcaaagagatggctcctaggtccttgagaaagatattcccggattgtagaagatttacatctcaaagaggcagagaatatgtttttggttgcaagtttccctaaagtaagcgctctaagaaaagagaggtcaggagcctatagtcaaataaaagcctgtctagagtttagtcacattaagtttgttttggtcagttggtcagtaaaagccattttattttcttcctttttaaagattatcttgactgcttttggccatttcgatctccatatgaattttaagaacagcttgtgaaccctgcccccaaaaagaatctgctgtggttttaattggatttcatctattctctggatcaacttgtacagaatcaacatttttattatgtaaagtctttcaatcctttcatttagttaggtctttattttctctcaataatgttttatagtttttaaagtaaaggctcttaaactttctctgagatttatttcttgggtttttatatttttgctgttatgaatatatttttgaaatttcattttctatttgtgctgatataaagaaatacagttgattttttttcttggtcttgtatccaggtaccatgctacatttacttaataatttgaatacattatctgtagtattattcagatgtacatatataggttgtttttgagtaatgacagttttctttctccctttccaattatttttcatgtcattaattttccctgacatattgtactgtataaatactctagtacaatgggagtattgtggatatttatttctcattttaagtctcagagggaagaactttaataaataatcattaagtatgatctttcctgtaggtttgttgtagataccttctgttcttaatattctaagaggttttatcactaccggatgccaaattttatcatatatttttccagaatcatttgagatggtcgtatttttcttctttattctgctatatgtcaaatcacatgacttagttttctaatgctaaaaaagcctttcttcctgtaataaactaaacctggataagacgtataatcttttttgtgtattgctagattttctttgattcatagtttttcctttacgtccatgaaagtgattggcctgttattttcctttcttgtaatatgcttgctaggtttaagtacctgattatgcaggcttggtaactggcttcataactggaatttgcaaatgggaaattttaaaattaaatttttatgtatttaatacacataaaaatgtccatttttaattggaatttcaacattacatttttccagattttccgttttggagtcagctcgaatcatttgtgtctttctaggaattggtctattgcatctaaaattacagatgtatttagataaagttctatttagtccctatggtatttaatagtagtttattagctaccattgtttgaaattgaaaaaaatgtgacatgaactaagaatttctaacctctctagagaaagcaaatgatctgatgatccttagtctgtttttctacatagtaaccagagcaggagtcaagttgccctgttttctctagcacaggctcttcatttagccacagtccccattactacctattctgttacacctacattatcttatgcattttattaggtatgtacgttagaatttgtgatttcttgtggatgaaaagttgtgatgtcaagagttggcatgagacatagagggatatttatcttctatgcacttgctttcaaataagataccttttggagcccgtgctcagtggctcacgcctgcaatcccagcactttgcgaggccgaggcgggcagatcacttgaggtcaggagtttgagatgagaccagccaacatggtgaaaccccatctctactaaaatacaaaaaagagccaggtgtggtgtctcacacctgtaatcccagctacttgggaaactgaggcacaagaatcccttgaacttgggtggtggaggttgcagtgagccgagatcgcgccactgctctccagcctaggggacagagaaagactctgtctcaaagaaaaagaaaaaaaggatacctattggaatatggccctgttgtttaaaattgtaaaggtaaaaattttcaattcttgtataaaacataagctttatcaagtatagaaaaaaatgcaaaaaaaattatcattaattgtccttctaaaatgtttcactgtgttctatattaaaattctatcatgctccagatttatcacatctggaataaaggctgatttttttatcgactgagctctaaatccttactatcacaagcatctcaataattcatcacagatttaagagcactttcacatttattgatctatctgaccctagcagttacctgtctaggagagtctgtactattatctctatttcactggtgagaaaactaaagcacagcaagattgagtttgttcacagatattacaaagttgggcaacagtagaactgaagtgggaatgcaggaagtttatactttatgtaatgattagcagattgaaagatccaaaaaagatggttctaagacaaaagttgggtggggaaagccacctattgataacgacagtagtagtattcagttttgggatatttgtgcaagacattaacctcaaaggtaaggagcccacctcaaggagctcagagtctgcgaggtataaaacgataaggaagaggaaacctcaagctaccaaggaatgcctgggaatgtgatgaatgctggaaggaacactgttacgctggaatgctccttagaactcctgctctttattttctggtatcccaattgaacagactggtgggagctggagagtacagagtttattaagctgccaaaaaaaaaaaaaaaagacattaaataatatcctgcaaagaataacagcagtgacaacaacaaaaggcttttccagatttattcattagcactttgtatactcacacaaataaataatataggaaactgactgaaatagcgtagagaagaacatgcttcttcgtgttaaaatctcactacactttcagcacaattgcaaaggcagaatttaatgaacaaatcagtcatacttaccttttaaaaataagtcctgcaaaggccacatgttcttaatctggaagtgcaagtatttgctgacgttttatgattaaacaaatacagagttacagtgtcaaatgtttttgaatcaaattataacattaagcttcacatccttgtgaagcagattagattaaatgttaaatctagtcaaacttctgctaaaacaaaatatgaaaagactccaaagggattcggcatctggatatctcactgtaggttgtgtagcacaaattagaaggcatatcttttataatgaatgccctactgaatgaataccattatgaacgagcatgaacttgtagccaaatggatctgaggtcaaatcccagacactcagtactgtggcttctgtgacctcagacaagttacttaacctatctgtcagtttcctcatctgtaacctgcccctttggaagtgacagctaaaaattccttgagttcagacaggagattattacaggatcatttaaatagaagtaagaattatacttttgaaaaaacttccagtagttgtttcataactcatcaaaataggtttatccgccctgtaccatatgttatacagtgaagatataaggtacaccattttatagtatggtgcttcagttcagtttgtagaaatgtgtaaaactgagaaccaagccatacccttggctaaacactattcagtaggactctgccacatttctgcctcataatggatttttgtttttttcaatggtttttgatgtgatttccatttcaacatcagtaagagtaagttgcttatacgttttaactgcatagttgttgataaagtaagagaaaaatcaagaaataagggattttcagagggctcattacacataaaattcatttagcagagaagtgtattatagggtcttaacctgcaataaaataagatgggttgttttctgcctccctctttcataaagccccgttgctgatgcattgtgtggtccatggcacataattgtttccgccttagtggatatacgcctgggaacactctatctcttaacgccaatactgatgggcacagtttaggtttcatattctatccctggctccagtaaattcaagggtcaccatacttaagatttacctcccaggcttgtcagattttcctcagttacctttatccaaatgttcttttagtagccatttttcacttttgaattgaaatagcaactcaaccaaacaaaggaattcagatgagaaatgtccttggcacgtacaacaatatgacatgtgaattaaatgggaggaaaaaatcctccccgttgtggatctgagcatggacgataatggagttgtgatttagtccatgaaaatgttagacgaagtgagctgacctttagcttcacttactgctgagacaaaatgagaatataaataaaaattaacttcttttaccattttgtgagactttgtaattcattggttttacatttatgtgtagaatgtttagctctataaaaatatgcattattgctaaaagctcaagggattcctatacgtaaatagaaactcagagaaacagagttgaagttacatattttttttttctctagagaagaggtttctaatcctaatacagtggttctttaaaaaatatatgtattagccccattttatccaatttcttacacttgtctaacaattttgttatagccattcaggcaatgataggaaccagcatctttgagtgattccagagctgagggatatagtcttccaattgctttgcttcattctttgtaattcaaattaaggccaatattgctaagcaataaataggtaaatccataaatttaaagcacttcgtgtattatctatttatacttgtgcatatggcatcacaaaaatgtatgggcagatgtttacagcgtatgagcaagtaatttctaattcacttttccgcttacactgagatcagtggaaagcactatgcctgccttgctacagaagtgacttagattcaattcattgagtattttctaagagtaagataggtttaagcaatagaatatgttactaaaggatatgtgttcatgctgtcttgtgttggaaacctttaaagaatatacttgaagactaaacatttattcgtaaagatttaatgggtgcctttctacagtgaatacagtaaaatagatgacccttggcagttcttagatttgatgtaagaaccatgatcaagcaaattgtaaacaacgaccaactcttaaataacttgtttcaaattaataatactttcccatacatactcttgtttaacatttgcaattctttaacgggttggtattattattcgacagacatttagccaagtatttcttgaaaaagaatccatctatcttaattgtcttttgtattactcctttgtgagggctatcattaaaaaataacatggactggtggcttaaacaatacaaacactttctcaccattctgggggccagaagttcaagaccaaggtactggcaaggattggtctcttgtgaggcctctctccttggattgcagatgaatgccttgttcctgtatcctcacgtggtctctcctctgtgttgcacatatccctggtgttttgctgtgtccaaatttcctcttctcataaggatacccatcatattggactagagtaaccctaatagactcattgtaacttaatggtctatttataggctctatctccaaatatgggcacattccgatgtagtaggtggggcatagggcttcaacatggatttcatgggacacaattgagcctgtaacatcttctcttaatatttggcatatccagatatttggtacatatttgttatataataaattcatgatcaatgaatgaatgcattgatggctgtcattaactgtaacctagatattagctgaatcataaacttgctccattatttggatataaagaacactttaagtggcattttttaaatagttatgttaaataggttgcctatgtacctaaaagagtgtttaattacagcaatccctccctccctccctccctccctccctcatccatggttttgctctccttggcttcaattactggcagtcaaccacagtcagaaaatattaaatgaaaaattccagaaataaacaattcataaattttaaattgcatgctgttttgagtagcataatgaaatcttgtgctatcccacctctgtctcacccaggactgaatcacccctttgtccagcgtcttcatgctgtcaatgttacccgcccattactcagtacctgtctaggttcttagaaacactgtcatggtatcgcagtgcttgtgttcaagtcaccctagttttacttagtcatggccccaaagtgcaagagtagttatggtggcagttcaaatatgccaaagaaaaactgtgaagggttttctttatgtgaaaaggttcccaacttaataaggcaagaaaaaaatcgcatgctggggttgctcaaaatctgtggtaagagcaagtctatccgtgaaattgcgaagaaagaaaaataaattcataaatactatatatagggttttgtactacctgcagttttaggcatccacctgaggattttgaagcatatcccctatggataaaggagaactactctattagttttttgtgactcatacagtgaacaaaactgcaatattaaatgcatcccattagtacatctcagaatttcaataaatttgaaaatgttatacaacctggaataggggatctttatttggatttgtattcccactaaaattaataaattatacatttccacctatggggttacaagcttaaaatgctgcttcagtggatactatatgtcttgtagcactagagagaagatgctatatatacttgaaagtcttttttgtttatgaatatgatgctatagcttgagtttgtcccttcttcccttgactgtcttcttcactggagttgatgggctacaataaatttcccacattttgactttgtagatctgcatcatcacgtcaggtagatggtgtagtttatacttaagagataagattttctccatttgaagcttttttctcccacaactaatctattaaccattttgttacgtgccattttacctgacatgcactgacagggtcactaggaagttagctaaaaaaatgcaagtatgttttagaaaaaacctatatatactgcttcgtaataattagatggttgaagtgactaaattcattgatttaagctcgcacatttcctgtgggtatctcgcatcactgtttgagcgctatggcttttattgtaaacataattcaaaataagttgagtagaaagtgaaactacaaaaaattaacagttacattatgctgaaagcaataacattgatatttatgaagaaaaactgaaaactcacttatgattgagctgcatataagtacatgattatgttaatactgtaggaaaatgttgactgccttctgtttacccatgcgtgtatttttttttaagtggtgatagattaaacaatttaagaaacgtgactctcctagtcacttagaaataggtggattagggccaggtgcagtggctcatgcctgtaatcccatcactttgggaggctgaggcaggtggatcacctgaggtcaggagttcgagagcagcctggccaagatggcgaaaccccgtgtctactaaaaatacaaaaattagccagacatggtggtggatgcctgtaatctcagctactggggaggctgaggcaggagaattccctgaatccaggaggtggaggttgcagtgagctgagatagtgccattgcactccagcctgggtgacaggagcaaaactctgtctacaaaaaaaaaaaaaataggtggattattttcatgatgctaatttcatttgcattgtttaaatcatgtgttaatatcctctaggtgggttaatacacatatgtagtataaagtaacatagaaattatgagaccttagacactgagtagatttttcaaaaatatgagttataaacatttttctaactctaattctatataaaataaagcacgtcaatattttatgatttctagctttaaaggtccaatatatatatgagaaaataagtttcttatttatatgaaaaagttacaaaaagttgaaaattcaggctataaagtgcatcataatgaggttgagctaactgccattttgaaatgcttcctttgcatagaaagcatcacaatatttgttttccttccaaaaatcattgatagttggtttatgttacatattaaaatagtgtgtgttcttagacattagtgacatgttaatgatatagtagtttttactcagagattgttagttttctcactagagtagtttagaaacagaaaattttaatacttttgtaataattgagaaaattgaaaaatctacatagtaatagaatttaagttactaagaattttcttctacaatccaaatggtaggcaattctcattatgcaagattgtttcaattaagagtcttttgaggcattctatttagtagttagacttttattctttagggtgtattttcaaacctaaggaaaatacaccttttacttgttctcactgcaaaatcctctctatatgtatgtctttgttatcttacatttgctatggagccattttatatagtggtataataaccacttcatattgcttgtctctttgcttttctatgaaaggtacaagacttggtgagataaagacaaatgacagtcacaccacttatttaaatgtaagcagatcagaaagagtgtcccttccaacttctagcgtacataggagactgagatactttggcaaattattcatgccatttttaataaaacgtagttaccaattgtttgctgatgctgtgcttgattgtctcttctccaggtattgggagatcgatgggcaaacatctgtagatggacagaagaccgctgggttcttttacaagacatccttctcaaatggcaacgtcttactgaagaacaggtgtgtcatgtgtgagaaactagctgtaaaagacacggggggatattaaattggaaaagtaaagatttatgtttatttattccttggaattctttaatgtcttgcagtgcctttttagtgcatggctttcagaaaaagaagatgcagtgaacaagattcacacaactggctttaaagatcaaaatgaaatgttatcaagtcttcaaaaactggccgtatgtactttctagctttcaatggtcttataaaaacccagtactgtatattatcactattatttagtctcttctatgctattgaatattaaatgtttatttttgcttggatcatagattattcaaagatgttatattgctacttttctgaattaaagtgggaaaaaactataggtggattttcaactttgtttttcaaagttgtactcttgataaaacatagcataccagaataagacttcaattaaaattaataaagtaatactaagaaatgtctgtgagcctttcataaagttctaagcagcatagttctaaaaaaatagactgacgttgattctcagaataatatgtgagagttacaagcgacggttatcctgacattgatggagtttaaccttagtttattataaaggggtacctgagactgggactgggtaacttatgaaataaagaggtttaactggctcatggttctgcaggctgtacaagaagcatgacaccagcatctgctcctggtaagtgcctcaggaagcttacaatcatggcagaaggagaaggggagccagtgtatatcacattgcaagagtggaaacaaaagagataagaggaaggtcccagactcttttaaacaaccagatttcatgtgaactaactgaatgggaactgactcatcatgaaagggattgtgctaagccattcatgagacatccgccctcatgagccaatcacctcccaccaggccctacctccaatgctgggaatcacatttcaacatgagatttggagaacagagatccaaacaatatcacctagtttttcaagcaaaaaaaaattaaagcctatcaaatgacattgattataaatacctcgagtgttttgagaatgagatttctttggcaataaatggatttcagaaaagacttcattgaagcatttggtttcagcaggaatttccaagatttaaaaaaaaaaaaaaaaactctaaagtttctcttactctgtgaattttatcatttctagtaaaagaggccggtctgatactatgagtttaatttttcacgtgacatattctactttatgatttcttaaaatttttgatagatttgattaaatgttcatttgatatgaacttttataaaacaaaatggttgtaagtagtgttccataatttcacctttattattgcattgtacttcataataatgcaataatttctaaacttaagtaaatttttccactcattttaaatacgtaccattttaccagctatttatttgtttcatacattttttttgctccataaatgctaaccctcattggtcttttaatttaaaatagattcacttatgtattacttgttattacaagctagcttattattgataagaaattattgctcaaagaatatggactttattaagtgatgtgactgccgaaaatagagttcagaaaagtaacctgtatatgtttgaaaacacgagtgcaaaaatatcagctgtatttgtagttttggcctgcagctgatggggagccattgagagtttgcaaaagaatcatatttgcatttttgtaattctttttggtaggaagatgtttgatggtacgaggactaatcagaagacctgaactaagtagcattgggcattaagataagaagagaaacattagaatgttaagatgtgatgaatgaaacttgtgataagaggcagaagtttgaaatggttcctagacatttcatttgggtgactgggttcctaggagggttattagccctaacaggagaatagaagaggaattgctggaatgacaaaaatgataattatttcagatttggatatattccgtgtaaaatgtctttgagacatccaagttaaaaatcctttccattaatcagttggtttacacaactagaatctcagaaaatggttcatgactagttattgattcagaagcaatcaaaatgcttctgagggattgtgtagagtgacacattaagtgaaacgaatagatttcagggaggaatgtctacaatcaaggagtaggcagaggataagatgttgaccaaaagattgagcagataccacaaggggaaagtggtatcacaaaagtgaggagaataaagatttcaaaaaagtaggaagtggtacacactgtcacatgccacagagaggagaggataaattcatgagggattctatcatatctagaggaatggatgcatggattacatctccttaaagcagaatattccttacaaacattgttcttctcaggcaaaatgtgaatcctttcagtaaataagtgagtgaccactgattatcaaaatgcagtcatgccctctgattaggagcgaagatatattgctagttaaatacagaatcatgtgcttcagacggtcaatcataatggtgatggtcagtcatattctgtgtgctgaaaaagtcacaagcctgcccagattcaaggaaaagggaattagatttcatttcctcatggagaaacaccaaggtcaagttatagcaaagcatctgagatgaggatattttacagccatctttggaaagtaccacatgccagaatagtacagttattttacatgatgataaattccaaatcttaatatctagtcaaagttcctgcatatattgttgactagatttaccaatcaagaaagttgttcttaggaagccacaaactgacaaaatccaaatatgttaaagctagatgagattttgcatctcatctagtgtttcttcaatctcattacacatgtaaagttcattaggaccatctactcagtttgtttccaagagaaaatcgagatcaagaaaaaacacaggatctgtatcctacaacattagtatcagacttaaaatgaacactaagacatccagactcaggtccaggcctttcaatctatttcagtagtcctcatatcagttgattccttggaaaaaataactgcaactgagaactgtcatttctaacaataatgtgcctctatgttaacatttttgtgagcagaaatcttggctagcctcagggccataaaaatgctcttttaagaaagtcaataattttccaataggattaaaatttgtgttatgtcaccttgcttgtgaacaaagagaaaatatgttttctataggtcttgtcatttgatagtttaagccaattaacaaaacctgacagctggtctagaatttgaggtaaaattcctttgctgactcaggcagtgaataagaatttaatgttcattaaaatatgtcacaatctgagacccaaaacaggtaccatctgtcaccagttttcactacatgtctaggtatagatacactgtgctaaactctcttctctttacaataagtgtaatttgtttcaaaatagtatcactgataacccatgggattgtgtcctgcttgccattgaggtgggaggtggggattatgacatttaatttgctctagatctttgggattcatatccaaatcatgtagatctattattttttataatcaaaactgatttaagttttaaactgatttggcatcagggataaaaatgaagggaaagaagaaacagtagcttttatgaggtgaattataagacttgtagaatcacgtaaattatcgtgggaagatccaagtcaagaagaaacctgttcctgagtaaatgtatttctgctgtggggactgttggcgtttgctggggaaggacagctctggggaagcagggtgatccaagagattatggtatataagggctacagaagtacttaggaattgaagatattctcaaatggctgtgggatcaaaggacatggatgaagtgctcatggtaactgagcaagttcctgtttgacttgctacctttacctcaactcctgggatggccctcaaataattaattcagacaggatcaatgcttctcaaaatgtgttcccccgaccggcagcatcagtatcaaggaaatttgttaggaatgcacattgttaggccatcttcagacctactgatttagaaactctggaagtggagcctagtcatctgcattctaacaagcctttcaggtaattctgatgttctttcaagatgagaacctctgtaatagatcaacctcccaaagtacaactggtgattagaatgaattggagcacatcttacatgtagataagtaactacacataatataggtggaaaactcaattttgccaatataggagaaattgtcttggcattattctcttatgcgtattcctgatgagagtgaggtgaaggtttcctgggccttttgtaaggatacattatcttttcacttcaaatcatcttgaacagcttatctgtctcttctccatatccactactgacccagtctgatttattgactgtaccttcctccctaccttggaggtaggtctacattcctggcttctataaaaataaagtctgtttattcttttactatcccagctggcctttgccttgtacacattctctagatcttccttttgccacctgaattttctagagctctatgggtctctggcactcatagacctatggttaattattgatatgtagaaatacatattttatgcaataattagtaacaaatcatagttatttaatatgcacatgtaagacctaagcttaaaagaatcagcatcaatggatagacaggacaaggtaattctaatgaattctatgatctaatgtatctggccccatcatggattttctttcttttcctccctcagttaataatcctgggggagttctggaactgggagatgactactgaaagacagaaaaagagagagaaactgagaccaaacaactaatctgccatcatcatttttgatactcatatctaaaatttactaggtataagtctgggttcagtgtttttgtcatacagacatataaaaattcatttattcaataatcacacaatgtaattataacattgattttactttaccttgagtgcacttttttcctaattggatttttttttttttcttgagatggagtcttgctctgttgcccaggctggagtgcagtggtgtgatctcggctcagggcaacctctgcctccctggttccagcgattccttgcctcagcttcctgagtcgctgggaccacaggcatgcaccaacattcccagctaattattgtatttttagtacagacgaggtttcactatgttggccaggctgatctggaactcctgacctcgtgatccgcccgcctcagcctcccaaagtgctgagattataggcgtgagccaccacctctaattttatttttaatggtgactttcactttcatttttgtaatgcttaccaaatgtttcttcatgtggcttaataataaaacaggaggcttattttcatttgtttaggtaccatgaggttactcataggtttttattgcaatcctcttctttaaacataattctcacactcctcttctgacatgtttccaaatcattacatattttgtttaaataatgggtagaccattcagccttacacatatggctatttaaaatagtttctaacattctgagtaagtaagtcaaagaggattgtacttagattttttttttatttttagatttgtgtctttgtgtatattgtgcctctttccatagtaaagaaaaaaaatgacactataactggaggaatatacattgaaattcaaatatggctctcagcttgggacaggtagcatcaacctttgttctagtactaatgcaaatattcacttaaatttaatggaaaactaacaagtgaattaaacaaaatgaatatgcaaaacctatctattgggctgggtatggtggctcatgcctgtaatcccagcactttgggaggccaaggcgggtggatcacttgaggtcaggagattgagaccagccaggccaacatgttgagactcctgtctcttctaaaaatttaaaaattagctgggcttagtggcatgtgcctataataccagctactcgtgaggctgacaggagaattgcttgaacctgggagacagaggctgcagtgagcagagatcatgccactgcactccagcctgggcgacagagttagactccaactcaaaacaaaaaagaaaaaccacctacctattgctaaacccccacaccgtgagttttattttgatttgaattcagtgtataatatcttaatttgtattttggtctattgcattctttcaaacttagaaaaatactgaacttattgttaaggaaaaattagagatgaaacttaaatcttgctttgtttccccttaaaaatggcatgaagactgaactataacatactccaggtgaagcagattctgagtaaaagacaaactaattgaaggagccactagagcattctgcagttcagagctatcaatgcaggtgccatgccaaaatgggctacttagattgtccttttcaggaaggtgtattgactgctctaggtttggggcactttgcttcatgggcaattggtgcatttgtgtcatgacaatttgctctgtggtatgttagttcttaaataaacttacatttgtttcggaaagacaggtatcgcgatttagtttacattcattgtatttgctgccaaatatggggttgttaagtggctgtaagataattttctcctttatttctcttccttcttctcctttgtttacagattaagtcagggagtaatgttcagtacccaggaattgaatttgtctgtgtatcaggcaaagttactgagtcaagtaaaagaaaaactgccctgatttactgatttcacataaaccacttattcctttcaaatcaaccaaagggagtttgtaaccctccacagctcacaggaactttggaaatataaatggtataaaaattgcttcataagacacataagtatttataaactctgaaaagagatgctgaagcatttatgtcatgcccagcgacttagttcttttacttaatgggctctacaattagttttaaaaaataattactcaaataaccagatgttaattgattaatggatgctacaaaaattttatggtcagtaaatcacataatgagattttatctccaaataatgaaccgaatgttaaaactgtggaaacaataatattgtaattttatccaaataatcacagcatttcagaatggcaagtttccttagccattctcattttctcagctcactagcttttcttcagtactcctggtacctgattgtcagttttcgtttgaattccgtcaggaattaaggggaaatccaagatccgtgccttctaatttccacatgttgatctctgttttgccttttgaagcaatattaccttttcacttggattttcttcaaatatttcaaggtagctcttaattacctctagtaggtctttattctacgtttgagtttcttttctcttcttttctcttcaaacttcttgggataattagatagattataactttctacctctatttttctgaacttttgatcctttgcgggcacgattgaaatattttcttatctatgcaaatgagcaaatacacgcaaaagcagattgaactatagtggtgtatggaatgcaacccaggcttattctgtgatctttcttgttttaacaggttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacaggttagtgataccaattatcatgctacagactatctcagagattttttaaacctgcattaagagagtgacattataaccctacaaaagaagcaaccagattagtttttgccctgtgtttagttaaataaaaacatgattcttttgcctgtcttgttgttggagaatggtggtgaggtagagtgctaattaactgaacttgttactgccctagagtgaatttcttccagcccaatagtaacggggaactgagtgacttagagcaggcgaacaaaatgctgggaactgtataatcacagtctaaccccaaatcagagattgctagaaccacgaggaacattagccaactccgttttactcttgagaaaaatgaaacttagggaagaaaagtaaatttttcaagagaagttagtggtaggagaactagggttcaggtcttttgatttcttggaaagttttttattagtgtagttaattatctgactattgtaccttttctgccatagactgctgatttcataaaattatgaatgtggcttagttatactaacacatacgggctgtagattatgaaaacatctcagctacatttggggtatgtggttttattataataatttttaaagatttagtcactaaaatggggtatcgttaaaagttgaacctctttttgtcttatgtagttggatggtagaataatgagtagtcattcaagatataaacattatatataatagtatttaacatattctgccacatagcctggcattataaggaataactttactcaaaattcatagctcaatgcacaggcatacacttccatattcaatagattttaggcaaatatttcctctatattgagacaagtacatggaatttgttttcttgagacctgacatctgataagtagcacttaggaaatgccttttggagacatgaagtttgtagtattgcctccaggaatacaatttaagacagcgtaataaaccagcctatatgattttcaatcacagttcaatgttacttttaatccaattttacgttaaaaaattataatttgaagaaatatgaatataaattgtaataatttcccacacaatcattacataataaaaactccatttgttttccattaaacatactttagcaattaattgacctaatagtagttttagtactatattatgattcctcctgttttatgtgatctgcccatggcttctttgcaatacattggtatttatgtaataaatacatgagacattagtcaatttgatactttttaacccaacactgagagtattcccatatgtacccattgcttccacagattattgctgccataaaatggtcagttgccgtgttaagaaagattgccattatttgataaagaaagttattttgacgtgcatcccttttaagggacatgtttagggagctgtaacagttaactgtaggtcatcttctagttcatttgcattgcatggagtggttctcaaacttgagtctgcatagtagccacctgaggagctaattaaaatgcatattcctaaacattttgctcagaaaatctcatccataagctgtgataaggacctaaaaatctacatctttactaagcctttgatacaatctgcagaccatagaggggatcaacatacactgggatctacttgaggtgggagggtgggaggaagtagatgagcagtaaataagactattggatactgggcttaatacctgggtgatgaaataattggtaagcaaacccctgtgacacacatttacctatgtaacaaaccttcatatgtactcctgagcctaaaataaatgtttaaagaaaatagacagtgatatgtgtgtgaatcccaacattctggttttccacaatgctccctgaaatgtgaaaagggagagcttcttgggaatacactatataaatatgctcattcccttggaatgggactactttttgatgaagtttgtacatgtcatcgaaatattactgatttgattattccaattggtagaaaagcatttgaagccttatttttaattccctagaaattatgagaccaccacctaggcaattgacgtgatgtcttccaacttgtataattctataataaaagaatactggttttgatttgcatggttctttatgaaataaagtccaacatgcattacagcatgtatctcttcacttgctcatagggatacaatgaagataaaatggaggcatagacaagaaagcatttgaggggaaaaaggttgagtttgatatgtaagtcatgtagttcagtgtgtctggagggctttttgtggttctctatctgcttttttttttttttttttttttgagatggagtctcactgtgtcacccaggctggagtgcagtggcacaatctcagctcactgcaagctctgcctcctgggttcacaccgttctcctgcctcagcctcccaagtagcagctgggactacaggtgcctaccatgacaccccactaattttttgtaattttagtagagatggggtttcaccatgttggccagggtggtctcgatctcctgaccttgtgatcctcccacttcggcctcccaaagtgctgagattacagacataagtcaccgcgcccggcccactatctccttttaattttattttcaaacagttacacgctcctattgtgggctagaaataaataaaaggacttaacatcatgtaagttgttttccagaacactaagcttgagtttttcttaagcttatgtttcagttttctctcattgcctttccaaaaattatgctgtcatgggattgatccaaatctttgctggctgtttttgagctcacaggaaggtagaaatggagctactcaggaaaagagaaattaaaaggaggtaaacagagacaacagcgaaatagtatcatataagagcaactgattttcttttatccatgttaaattgaccttgattaaaattacataaggagaattccaagaatatgagctgtaaggttgtgactttgaagaacaaagctcacttgtatgtacattttctataatgattgtgggagaaaaatgagtttcattaatgactactcacatgatatactcaattgtttcaaaaattcttttaaataattagtataaagaatgagcaaagttctcataatggttaaaacctattgtgaggcagggtgtggaaatcgtgattgagatgacaaggcacccagttgtactcatataaagaacactgcttgcgcgtatgattgctgttcaggtcagagctttgaggcatttttgaccttttgaagcagttgcatggcaagagatcaaaacgtgaaaaaataatcagctaggaggactgctctcttgcatttcaaactcagatttgacttgaataatacctggacacaagctgagggtatttaagttgattagaaggtagcctaagaagatagaaaatactttttttctaaatgttggagagataataactcttgctatctggaggcttacaatgagaaaagagggcaaatataccctggattgacttctttaaaaactcaaatgatcatgattccctgtaattttttataaacatacttgtaatttgtgcagttttttctaattgccttggccctgatcgatatatattttatcttgatcataattatgaaatacgatagtgacgaattccatcaacatttgcttgtctggaaaagattttattcttccttcacttatgaagcttactttgtctggatatgaaattctgccttggaaattcttttctttcacggtgttgaatattagcccccaatctctactggcttatagggtttctgctgagagatctgctgttaccctgatgggcttccctttgtaggtaacctggcctttctctctggctgtccttaacattttttctttcatttaaacctggagaattgtatgattacgtatgttggggttggtctgctcagtatcttgcattccctgaatttgaatgttgggctggcttctgctcagtgagtatcttgtatttcctgaatttgaatgtttggctggctttctagattggagaagttctcctggatgatatcctgaagtgtgatttccaacttggttccgttctccccgtctctttcaggttccccaaacagtctttgcttcagaatttacataatcccacatttgtcagacgttttgtacattcatttttattcttttctttttctctaatcttttctgcctgtcttatttcagcaagatagtcttcaagctctgagattctttcctctgcttggtctattcaggtattgacaatgtgatttcattgtggagttgtcgtattgcgtttctcagctctatcaggtcattcatgttcctctgtaaactggttattctggttatccgctcctgttacgttttatcgtggttgttagcttgtttgcattgggttagaacattctcctctagctcagggaagtttgttattatccacctttgaagcctacttctctcaattcatccatattagcctcagcacaccatctcacgccagacagaatggtgatttttaaaaagtcaagatacaacagacgctggcatggtttcagagaaatgggaatgcttttacactgttggtgggaatgtaaattagtttatccattgtggaagacagtgtggtggttcctcaaagaactagaaccagaaatacccagcaaggccgttactggatatatacccaaaggaatataaatcatcctattataaagatacatgcatttgtatgttaattgcagcactattcacaatagcaaagacatagaatcaacccaaatgcccatcaatgatagactggataaagaaaatgtgatacatatacaccatggaatagtatgcagccataaaaaggaatgagagtatgtcctttgcagagacatggatgtagctggaagctgttattctcagcaaactaatgcgggaacagaaaaccaaacactgcatgttctcacttataagtaggagctgaacaatgggaacacatgggcacagggaagagaacaacacacactggggcctgttgctgggagaggaggagagcatcaggaaaaatagctaacggatgctgggctcaatatctacctaatgggtctgtaggtgcaccataccaccgtggcacacatttacctccataacaaacctacacatccaatacgtgtaccctggaacttaaaaaaataaatgtgatagtaagaaatttattataattaatattttaaaatataatgtatgtgatttgaagcattactttcctcatttgactgaaatcacatgtgctgttgaaagggtatattagtcatatgctttacaatttggtatgctaattgtaattatcatattacgccataaattgtaattactgtatttaatatgtaatttatattaagtagtatataccaggtgctttggtgtaagcatatatatatatattttttttttcaagcgagtctaaaggttttgtagttttgtggatttttagtagaataaattgtcttctttctcaggaataaggaaagttgtatgacttattaaggttcaaatatctcattcccattttgtgaatattttgctatattgctaacaacaatttttgcaacattctcaactgtgagcacctctttaagataaaatacatatgctcagaatttgcctcttcttgtacatggcagttcatgtttatgctgtatatgtttgtgcctacattcaaggatgcccaaaaagagaaaatgattattatataattatgtgtaccttctatatcatctatatcctgatgagagatttattatgtgtgctgccgaagcaagcacctgatgggagatttaaaactcctatcaaatagtaatataaaacatagctgtaaatgataagccagtgctttttattatacccaaaatgcaaatagaaatatgccaatgtaccaagatgaaaatttctttacatgttcttcttttctgagttaattctcattctttaaagatcctctattttaacccttcataaaatattttatgttcacgttctggctgtacccattctcagagcatcattttgtagacctctttgtacaagggggatatagttgcaaatggtttgcctctcttcttttttggccagtaagtttaattaaaaatactctaaggctttttatttaaaagaccttttcattgcttcctgaaagctctccacgactagtaagcctgatgccaattaaaaaagaaaataattttttaaaatctggaattaaaataaaaataccttacttattttgtgtttccttcttacttaaggtcatagaattaactcccttaaatttgagaacatgttttgggtaattcctcaggttaaagttttattagaaaaatttgaagttgaccgagtgtggtggctcacacttgtaatcccagtactttgggaggacaaggcaggcaaatcatctgaggtcaggagtttgaaaccagcctggtcaacatggtgaaaccccatctttactaaaaatacaaaaaaagtagccaggcatggtggcaggcgcttgtaattgcagctacttgggaggctgaggcaggagaattgcttgaacccgggaggtggaggttgcagtgagccgagatcatgccactgcactccagccgggatgacagagcgagacttcgtctcaaaaaaaaaaaaaaaaaaaaaaaaaaaaaagaaaatttgaagttacatctcaaataactttggaaattaactgtatcattttgctatctccaactataataggtatttgagaatgggccttgtatatcagtgcaataggttttaccttgtaaatgcattgtctgtaacaatataaaatgtaagcactaaaaaatttaatacattcagtctgagttaactcttggaatctctcattctttatttataaatttaaaggaaaggtaagctaggcagatttctatagtggccatcgagttctaaatgtctttgatatgtttctctttgcttttatgtgaaactctggagtacttagtgaagaagattcctacttttgccactggaaaggcagctaaaaaataatgataataacatcctatccctattcaaaggagacttaattatgaaattattacactgtattcactgagtatgtcattaaaataccatacagacaaaatgctcagcatctgtatgatacgcctattatctcctgacaaaaaaatgaaataacacataaagacaaatacaagtctttttcctaagcctatacttgataatatccatccctaattatagaatgtgtttcattacttcagtgttagatggtatgtagaggaaggccagatggatcagaaaaattaaatctcattgctttgcaatttttgcaggtgcagttaattcacacagttgctcaaattccgtatttaatatgaatccagaagacaacatacatctcttctttctgatacaatttgtactaaagacaatttaaaatgaggaacaaaatacattaaattggacagacagttttacagaataaaccttcttaattatcatataatatttatttcgaagaaacaaatgacttatgatgccttctaagtatttgacaataattttgctcatgatttcaatgtcagtacttattcaagaaattttattaccttacagtaataaattaattattaatataaattaaattattattaaattattgtaataataaattaattacagtaattaatagtaaattttagttaccaggctactgtcctgaactttggcactcattgtatgctacattcagctatgggaagtcctctatacttcataagataaagcattttacatccttgtgattagtaactcagcttcctttgtgaccatctgatcttttgcccaaggattctcccaaagttcaacatataaatattttcttttgcttagagatgcaaatctttaccagatttttgtgccttgtgctaccatgcctgtggagttggtttttaagcatggctatcaattattatctaaagctgttgctatgattatgcagtatgttttaaactgcagaagtgcaattcctccatgcccattaaaacttattgatcactccaaagggttacatatacatagacagacaacgcaatgaaaagccttgatccacagttgtcaacctgattgtgtgtgtgtagtgtattttgactaattttgcacagatttcaatatagcatgtcaagagccaaacatatttaacattgagtaattcttcctatataatagttatgatgtgccattgtttacaatttcagtattctgaatttatatatgtgtgtgtatgcatacaaatacacaccccttaaaaggaaaccaccattcaaaaaagtgtacaagtgtaggagcaagtgagcatagctgataagagttggatgaatgaacattcagacttggatttatatctatgctttgctactaaaaagttttatctgcctcaacaaggtcactttcatctataaaataggaataatattagtacttactcttagggccattgtgaggtcataatagctaccatttattaaagctttacaacatagcaagggagtttttctagatcttttgaataagataatcaattcaaaacacttattgtaatgcctggatcatgcagaaagcttcataactggtacctgttattgcaagtattagtatttgcaaaataaagattttatgctaaattagtaactaatactttatagcttgaatctttctagtaagtatctaaatattcaaatactagaatatctcaaaaggcaagaagttgaaatctcttatcccagcataacaaaaaagttacaaaggcaataatatgtaaataattaaatggaaagttaaaagtttcaattaagaatatcagtcaaaaataaaaggaaaatttattagcctgttcttacactgctataaagacatacctgaaactgagtgatttatgaagaaaagaagtttgactcgttcgtgtttgtggcattatagtattccttggtgtaaatgtaccacattttctttatcttgtctatcattgatgagcattaaggttgattccatgtctttgctattgtgtatagtgttgcaatgatacacatgcatgtatctttataatagaatgatttatatttgggtatatacccagtaatgggattgctggcttaaatggtttttctgcctctaagtctttgagaaatctccgcattgtcttccacaagggttgaactaatttacactcccaccaagagtgtaaaagtgttcccttttctccacaacctcaccagcatctattgttctttgactttttaatagtaaccattctgactggcgtgagatgttatctcattgtggttttgatgtgcatttctctcatgatcaatgatgttgagttttctttcatatcgttttaggtcacatgtatgtcttcttttgagaagtgtttgtttatgtgctttgcccactttttaatgaggttatttgtttttttcttgtaaatttgtttaagttccttgtagactctggaccattgtcagatggatagatggcaaaacttttctcccattctgtaggctgtttatttactctgacggtagtttattttgctgtgcagaagttctttagtttaattagatcccctttgtcagtttttgcttttgttgcagttgcttttgccattttcctcatgaaacctttgcccatgcctatgtcctgaatcttattacctaggttttcttctaaggtttttattgtttggggttttgcatttaagtctttaatccatcttgagttaatttttgtatagattgtaaggaagaagtccactttcaattttctgcataggactatcccagcactatgtattaaataggcagtcctttccccattgcttgttttttcaggtttgtcgaagatcagatggttgtaggtgcgtggtcttatttctgagttctctattctgtttcattggtctatgtgtctgttcttgtaccagtaccctgcttttctggtgactgtaaccttgtagtatagtttgaagtcttagcttttgggctgagacaatgggggttttctggatataggttcatgtcatctgaatacaaaaataatttgacttcctctcttcctatgtgaataccctttatttctttctcttccctgattgccctggtcagaacttccaatactatgttgaaaaggagtggtgagagatggcatccttatcttgggccagttttcagggggaatgcttctagcttttgcccatttggatgtgggtttataatttatggctcttattattttgaggtatgttccttcgatacctagtttattgagaatttttaacatgaagggatgttgaattttattaaataccttttggttgtctattgagatagtcatgtggtttttgtctttagttctgtttatgtgatgaatcacatgtattgatttgcatgtgttaaactaaccttgcatgctagggatgaagcaaacttgattgtggtggataagctttttgatatgctactggatttggtttgctggtattgagaattgttgcatcagtgttcatcaatgatattagcctgaagtttgcttttctttctttctctctttctttctctctctctctctctctttctttctctctccctctctctctctttctttctttctttctttctttctttctttctttctttctttctttctttctttctttcttctttccttctctctctctctctctctctctctctctctctctctctccctccccctccctccctccctccctccctcccaggttttggcatcagggtgatgctgacctcataatataagtttgggagaaatcccttcttttcaatttttttggaatagtttcagtggaaatgataccagctcttctttgtaccgctagtagaattcagctatgattccatctggacctgggcttttgttggttggtgggatatttattattgcctcaatttcagaacgcattattgatctattcagcaattcatttcctttatggttcagtcttagaggggagaaatgtgttcaataatttatccatttcctctaggttttctagtttatgtgcatagaggtgtttatagtattccctgatggttgtttgtatttctgtagaattattggtgatattcctcttcaaatttttcattgtgtttatttgattcttctctcttttcttccttattagtctaactagaagtctaccttttttatttttatttttttccaaaaaccagctcctggattcatttagttttttggagggtttttcatgtctttatctccttcagttcagctctgatcttggttatttcttgtttgtttgctcttggtttgctagtttttttatttgagatgttaggctgttaagatctttctagctatttgatgtgagcatttagtgctataaatttccctcttaacactgctttagctgcgtcccagagattctgataaattgtctctttgttctcattagtttcaaagaactgcagaggtggcagctggtcttcctcccagaagctctgtcccagggagagatcagagctctatccattgaatcctgggtggaatggctgaagccccctcagggaggtcccacccagtgaggaggatggatcagggtcccacttaaagaagcagactggccacgatctggcaagggttgccacacactttcaaacaaacaaatctcatgagaactcttatcaggagagcagcaagggggaggtccacacccatgattcagtcccctcccaccaggcccttcctccaacactgaagacagaattcaacatgaggatttgggtggggacagagagccaaaccatatcataaaataacagcataaacaaaatgaatttaaaattaaagaatagctgaatagttcgtaattgcaactacagtcatatgctgcataacaacatttcagtcaacaatgaaccacatatatgacagtggtctcataatattattatactatattattttttacttttatttttgcttcagaggtacatgtggtggtttgtcatatagataaattgcatgtcacaggggtttgttgtacagattatttcatcacccaggtaataagcatagtacccaataagtagtttttttaatcctcaccctcctcttaccctccagcctcacatagaccaccgtgtctgttgtccccttctttgagtccgtgtgttctcaatgtttatctcccacttagaagtgagaaaatgtgatattttgtgttattgtgttagtttgcttaggataatggcctccagctccatccatgtttgctgcaaagaacacaatctcttttttcatggctgcatagaattccacagtgtatatgtaccacattttccttatccagtctaccactgatgggcatttaggctgattccatgtgtttgctattgtgaataatgcttcaataaaacatacatgtgcatgtgtctttagggttgagggatttatattcttcttggtatacccaataattgttattgctgggtcgaatggtaattctggttttcgttgtttgggaaatcaccaaactgctttccacggtggctgaactaatttacactaatatcagcagtgcaataaacgttcccttttctgtgcaaccttgccagcatctgtgattttttgacttcttaataatagccattctcactggtgtcaaatggtatcttattgtggttttgatctgcacttctctaatgattattgatgttcagcattttttcatatgaatgttttctgtatgtatgtctttttctggaaagggttcatgtcctttgcccactttttaatggtgatgtttggtttttgcttgtaaatttaagttccttgtagattccagatattagacccttgtcagatggaaagtttgcaaaatttttctcccattctgcaggttgtctgtttactctgttgatagtttcttttgttgtgtagaagttctttagtttaattaggtcccagttttcaatttttgtttttgtttcaattgtttttggtgtctttgttatgaagtctttgcagtttcaatgtccagagtggcattacctgggttatcttcttaggtttttatagttgttggttttagatttaagtctttaatccacctcgggttaatttttgtatatggtgtaaggaaggggtccaatgaataggcagtccttttcccattgcttgtttttgttgatttcattgaagaacagatggttgtaggtgtgcagccttatttctcgactctctattcttttccattggtttatgtgtctgttttttgtaccatgctgttttggttactatatccttgtagtatagtttgcagtcaggcaatgggatggttccagcttttttctttttgcttaggattaccttggctattctggctcttttagtggctccaactgaatttttaaatagtctttttcttattcagtgaagaatgttattggtagttttttgggaatagcattgaattaaaaagtgctttaggcattatggccattctgtcaatattgattcttccatgagcatagaatatttttccattttttgtgtgttatctctgagttacttgagcaatattttgtaattctcagtttagcagtgtttcacctccttgcttagctgtattcctaggtatcttatttctttttgacaattatgaatgggactgtgttcttcatttggccttagcttaaatgttgttggtgtgtaggaacactagtgatatttatacattgattttggatgctgaaactttgctgaggttgtgtatcagatcaatgagcttttgggcagagactatggccaaagtatagaacctcatcgtctgcaaacagggataatttgacttcctctcttcctatttggattgcctttatttctctttcctgattgctttggctaggatttctagtactatgttcaatgagatttgtaagagagggcccccttgtcttatgccagttttcaagcacaatgcttctggcttttgcacattcagtataatgttggctgtggactttttaaagatggttctaattactttgaaatatgttccttcagtgcctagtttgtcgaggatttttaacatgaaagggtgttgaattttataggatgccttttctatatctactgaaatgatcatgtggtttttgattttttgttctgtttatgtggtgaatcacatttattgacttgtgtatgttgaatcaacctcgcaaccctgggatagaagctccttgatcatggtggattagctttttgatgtgctgctggattgggtttgctggtattctgttgactatttttgcatctatgttcattagggacattggcctgaagttttcttttttggttgttgtgtgtctgccaggttttggtatcaggacaatgcttccctcatagaatgagttaggaaggagccgctcctcaatttttgggagtggtttcataggaatgataccagcttttccttctatatctgttagtattcaggtgtgaatctgtctggtcctgggctttttctggttggtgggctttttgttcctaatttaatttcggaactcattattggtctgttcaatgattccatttcttcctggttcaaacttggaaagttgtaagtttctagcaatttatccattgcttctaggttttctagcttgtgtgcataggggtgttcattatgaatagtctctaagggttttctctatttctgtggggtcaatggtaacatcccctttgtcattttttattgtgtttatttgagtcttctctctttttttctttattattctaggtagtggtctatctttattattaattatttcaaagaaacagctcctagattcattgaccttttctgtgcttttttgcatctcattttccttcagttcagctccgattttggttatttcctgtcttctagctttggggttagtttgctattgtttctcgttccttgtgatgttcgttttgtaattagagatccttctaactttttgatatgggtgtttcgtgccataagcttgcctcttaacgctgctttgtgtgtgtcccagagattctggtatgttacatctttttaaattttcattagtttcaaataatttcttgatttctgccttaattttattgtttacccagaggtcattcaggagcagtttgtttgatttccattttaatgtatggttttgagcaatttgcttaacattgatttctatttttattgcactgtggtccaagagtgttgttggtataattttgtgggttttaaaaaaattttctaaagattgttttatgcccaactctctatatcatatttttattgtacctttcgatatgtttggatacacaaatacttaccattgtgcctacactattcagtatagtcacatgctgtacaggtttgtagctaggagcaataagctgtaccacataggttggccgtatagtagtctgtaccatctaggtttgtgtaagtacactccacggcgttcgtacaaggacaaaattgtctaaggatgaatttctcagaatgtgtcccagttgttaagttatacatgacttgtagtgattcctaataaactggagacagtggtagaaaaaaagtattttattttattgtatgtccttttgtattctttaaatttgctttgatgtacttatgtttctttttttaaatgtgcattttttaaacaagtggaagagaagatggaaagaaagaacttcatttcttgagcatagtttgtttttcccaggcctatcaaaataacacaatcttactgcaagaagaggcacaccctggaataatatcaggatgctggcaaatgctcttccaatttttctcagaatgagaaaatgtaaattttaaagtttaaatctttttaacatatgtaatcttatgagtaagaaggttgagtatagaaaaattcttcaaatttccctgagcgtttagaaaagatagtggttactgctgatatttaccattatagagcacttattttattcagatattatatcatttaattctcaaaaccaggactggctacataatttgtgggcccagtgcaaactgaaaacaagggcttcctgttcaagacctaagaatttcaagacagtggaagcagagcttgaaaacaagcatggaagcctcctgagcaggggccctgggcaactgcataaattaccagcccatgaagctgtccttgcttgtaacacacctgtgaagaaatgtgttactcttactttaaagatgaagaaaataatgcatagatttgagataagaaccaaccagccccaaatgtcacagtgtataaactatggatctggtgtttaataattgtggagactggctccaatgcctctacttataaccactctaagaggaatcagctcccaaatgtaaagacaagtatttctaaactatttcccatttttactagggaaattaacttgcagttaaaatgaatagtattttaaaaagaaatgtattttcttttcatgatatcattttagagtcttaaatagactcataatcaaaatgaagaaaggtgactgggtaaaagtatagttagctagatacaaagattgttgaatataggtcaaactatattctattctagttttgactctgccatattaaacattttagtgaaggcactacgttattcttatcatgcttgaagttttcctcattctaatgcattgagtgacaggagtatgattccatagatcttaatatataaatagaaatgatagatttaaaacaaacagtttggcaaaactttcaaaatttttctttgcttacaaatgcaacattttgcagataatatcttatagaagaactttggaaactaaaggaatacagaaatatacactgtgcaacagaaattttctctactttctctgtcaaaaatcaaccaatgtttatgtctagcattgtttactcaatagtgtaaagcaaacgttttccaatgacattaaaatatttgaaatataatactccatccacattcatataccataatgtacttaaaccatcatctatgacatgaggttgtttccaaaagttactgttagaaagaccctataaacaaggataaatattatatctagccttcagcatcaaattaaatctaaatgttaaaatgctagctgagagaaatctgttttcataacatttaaagagaaaattacttgattactgtatgtttggtgtatgtaattattttgcatactggtatttttcacgtggcattcatcttcacaattatttgtgtgattatcatcgtccctattttgccgtaaggttcctaaatatggagtttctattttactcatttctgaatgtcctatagtgaatatatattcaataaacattagaattttatagaaaccttgtggttcagctgctgaataacttacacagttttagaattctttgattgactatggtgtccaaagccaagaaacattggttttggatgacgaatcaagttatatctacttctagcaaataactggcattatagagtttgaaaatgatatttatcagggtcatgattattagatttcaaatcttagaatatcaggtagaaatgatattcaatttactctgctttcattcagaactcaaaacaagttttaacaagaggaagtcttaatcaggcaggattcctctggttgttaagaacatctttcccaatggggaaagtttgcttgcatgctaagaaaggagctttctgtttcagggagtagtgagctctgtaataatcaggaggtcatgttaaatggccttcgtagtccctctcctgtctatatttcctaatgattctaacacataattaagtgtcaataatagttatagtcaataactataagccataaggaaatttagtacatgactgattgttttttattctgattgtatgaagtaggttttgagagtgattattaatttgttatatgtaatgagttctaccctatatttacagggtgaatgcacagttttcttatttctccatcccgaaggaaatgaagtagtatttttcaattacagtgtagtagtgattattatatagaacaattacagactcatgtcttactactcttttattaaaaatgattcatttttctttcttaaaaggttgagtatatttttaaatgccgcttcacagtatatcatgttgtcatttccctttaccctccatgggcacatgtatccaattttataagtagataccacgaaaatattaatattacagaaattaatttaagagtcaaatttttagtagcacaaatgttctatgagattggatataactgcatgaattagcttggtattttcagaatctctgcattctggtctgtatgtttaaaattaggtattttcttaatctgcaaaatattatcttctagcctccactgtatgcaaagaaagtgtgctcatggttaaaaaaatattcaaataaaaaaataaattatcttgggatcctactaaaaactgcattttctttgcaaagcaagttttctcatggttaaaaaatattcaaattacaaagtaaatgctcttggaatcctactaaaaactacattttctttttgactagaaataaaactaattttatcacgtaatggtcattttgtgttgggtgcaatgtttgagtttatattttaagctttttttagagctatgttgctttctgctttcatcttgacataacttgtcaacagacttataattaaagttgtttgaggttcagtgattcattctaaataatgaatctatggagatcctagagaagataaaacctgtgcttggcaaatgtagaaactgtaattcttagtatccttttagcctaccaaaatggaaatccttcagtccctcacataggtaaagatatgtctttaacaaaaggtagcctttttaagctatgtatgtcaaagcaatttttacttaagacatcatggaaaagattttattccttcactgttcattgccaatttggaagctgaaataagaagatcctgaggcttttcccatttcctcacatgaaaggaatcagtcctcgtgtatgaggcagggagattactacaaacccttcccttacctcttggcaaattcaggaaaattgctaaaatgaatcttgacccagccagatccctgctcctttgcttgtaaccagaggcagtttcaatgcaggcctcttgtgacttccttggaaacagaccttgcatataagttggattgccagaaggataatgattaccatcccaagaggtaacgttacaatcgtcatgagaggagctctgtgagacggagaatatgataaggaatgattgtctcaccattatatgacttgtctatctcgtaatgcccatgtattgaggtgatggcctctcatgtcttggctcacaaaatgtattattccaaagatggatgaactgttgcccccggcccgctgccaaaagtatgaacaggaggtaattgagattctaaaccaagaagtgtctccagtgatgaatatgggaactcaaatatttgaacataatcactaatttaaatcaaacaagagtagtgtgttttttagcatttgaataacattcaacataaagatatatatggactaatacatactttatgttaaccttttattgtaattttaaaagctgtttcacttatttgattaaagagtcgttcattaccaagttgaaataattttatttaaaaatgtataacataaaataatcaatgtgtatgataaccaaaaatgcattctacaaactattaataagcatttaaaatgttctaggcaatggaattggtactgatgtacgttagtaacattcatattaatgtaaacattttaaacagcatgtagaattaactatcagaatgaattatactctacatttttctcctctgcccccaccccttatttcctacagtttgaccaatatattgaaggggcgctaaattgactttcgatgttgagattactttcccttgctatttcagtgaaccaaacttaagtcagataaaacaattttatttggcttcaatatggtgctattttgatctgaaggtcaatctaccaacaagcaagaacagtttctcattattttcctttgccactccaagcagtctttactgaagtctttctagcaatgtctgacctctgtttcaatacttctcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggtgagagcatcttaagcttttatctgcaaatgaagtggagaaaactcatttacagcagttttgttggtggtgttttcacttcagcaatatttccagaatcctcgggtacctgtaatgtcagttaatgtagtgagaaaaattatgaagtacattttaaaactttcacaagaaatcactatcgcaacagaaagtaaatgcttaatggaaatggtgttttctggggtgaaagaagaaactatagaaactataggtgataaactactgtggtagcattttaatcctaaaagtttctttctttcttttttttttttcttccttataaagggcctgcttgttgagtccctagttttgcattaaatgtcttttttttccagtaacggaaagtgcattttcatgaagaagtacacctataatagatgggatccatcctggtagtttacgagaacatgatgtctcagtctgcgcatcctaaatcaggagtaattacagaacacatttcctgttctttgatatttataaagtcttatcttgaaggtgttagaatttttaactgatctttttgtgactattcagaattatgcattttagataagttaggtattatgtaaatcagtggatatattaaaatgatggcaataaaattttatgagtgcaaagctggcataaaaattattttaaaaggtacaatttccctttcattccagttattgtaattctaagattaagaaagaacgttaaaatctgccgtatgtttttaagcagcatatgtttagaaactcatggaacacttgacattagaatttgtgtataccagggtagagaagtttgaaaagaacacacatctaaaaataccatgtcagatgttctaagaaaaaaaataaatctagagaagttattcaaatatattatttgggatgtttagtacttctctattaactaatgacttatgacctactttgataattccaaagtaaatcactgggccttttctccctggttgtgtcagcttggctaagcaaatccactagtccaggggtcaccaaactaagacctgctaaccaaatttagcatgctgccagtttggtatggctcatcagccaagaagtgtttttacgttttcaaatggttgaaaataatcaaaagaaaaataatattttatgacatgtcaaaattacataaaattcaaatttcagtgttataaataatgttttagtggaacacagccaaactcatttatttatcacttatgattactttcgcattacaacggcagagtttgaatagttgtaacacaaactgtatagtccacaaagcctaaaatatttattacctatcctatcacagaaaaagtttggcgacccttgctccagtcaaatggctctcaaactctatgaatattagcattctttttgtggcaacaactttcaggaacttccaagcactctactcacgatggtaatagaaaatctaacaaaaattgatggagtgaaaagcataatggcacaaatccgtgaagcttttgatgaatttcttttattattcctagtaagatgtacattaacttgtttgttgtcacattaaacatgtgtttatagacaacgcttagtggacatacagatttatggatactttgcaacattccaacaaccctccaacagttctccaaacagagtaatagggacacctagttgcctaacacttttaatgtcttcaggacttgcctaatacagaaattaacagagcaagctgattcatgtcaatctctgtcttcaaaagcttattattggctcctgtttggagaatggattgtgttggaaaaaaaaaaaaagtgtgttctgacttctttttgttttcaggaaagagtggctagtggtgaaataccttctctccaaaatttgtttgtatcataagttttcggcaatttttgtatgtgcctaaatgagaagtcccattgggcacatacagaaagattcttcaaataaaagctaacataaattgaggatttattatgtgctcagtagtagattcagtgctttattggcatcgcatgtatttttcccagtaacctcccaaaataggtatggctataattactttataaaattatacacagctacagtgtacctcagacaggatttgaactgaggtagctacaaaacctgggctgtatagtaaaatgtctttttcatagatatatgactaaggtaatcctattgatttacctgaagccatcccagttacacctgttgtcccagcataattatatatagcatcaactttcactctcaagtgtgtcctgatttggacggcaaaattatctgaacacgctatatacgacacttgattgataaatttagactgaacgaagatagcaaaaaggcaaacatttaggaacaaattcattaattgataattgtctacagggtggaatcttgttaaagtattgtaatgattaaagaggcatcatgcaaatataaccataagctttatattagctagtgccccgtttttgtatcatctgaagcccactaatatttcactgaatattgaggtcttgaccatctgttgaatagtgttttatttaaatgatgtcctcttccagcttctgtgacacactaccagttgtcacccacgactctttacctgacttgttttattccttctgccttattcctatgggagtatcacacagatccatctctttgcctttctgacttcttttattttgagacagtgtcttgctctgtcacccaggctggagtgcagtggcgggatctcagcttactgcaacctccgcctcctggtttcaagcaattctctgcctcaacctcccgagtagctggaattacaggcaccctccaccacatccggctaattttttttgtattttttagtagagacagggtttcaccatcttggccaggctggtcttgagctcctgacctcgtgatccacccacttcagcctcccaaagtgctgggattacaggcatgagccaccatgcccggccttttgacttctttatctggattatctcctctcattgattcgagcctggctctaagtgactgactcccaaatcatgtagctccagatgtgacactctccctcaaattaaagctttatatctctaaagctatttccgcttgtgcatccagcaactgcctcaatgttcatcaaatgcaaacatttgttccttccaattaaccatacctacttatacattgcacacatattttagttataattcattgcctgtgtgtctagagaagtagcaaatatggaaaaaatcattgcttttggaatcagaattactgaggtttgaatgctgccctttttttttttcccaacttttagtttaggttcaaggggttaacgtgtaggtttgttacatgggtaaattgcgtgttgtggctgtttggtgtacagataattttgtctctcaggtaatcagcataatatctgataggtagttttcccatcctcacctgcctcccaccttccactctcaaataggccccagtgtctattattcccttctttgtgtccatgtgtactcagtgtttatctctcacttataggtaagaacctgtggtatttgtgaaacctgcctgttttaattactagcttatgagcgcaggcaaattacttgttatctgtgcctcagattccagtattctcactttataaaacaactgtcatgaggattaaataagcatttaatacattgcctttaaggtggtaaacattcaataaatgcagtggttcgattcttatttggtggtggagaccatagagatgatgaagatggaggaagattgtggtgggtaggaggagtagaagtgatggtgggagaggtaacgatagtagagatgatgatgatggtggtggaggtagtgatggagatggtagtcatctattatcgacagggaaaaattccataataaacattatctcaaacctaagaaatgtaaaattaccttcctgttttcctcttcaaaacagaatttaccacctgacatctctagttctgtgaatttttcttctactttcttttccttatttattataattagattgtattattgggcaagtgccatcatttccgtcatttcatgttcattcgaattgccaagtccataacctgagccatatacctcactgtggagagaactgccctcctttctaattgatttactaaaatgaatatatctaaaatgatgctttttgatgtctctccagacatgcgaattcccataaatccagatacctccaaaataaaacccaagtgcttcctatggcattcagtattattctcattctccactaattttatgtctaccttcccaataatcattattccacttcagccagtaaattacattacattcgttttgttgtatgccttcatgccactcacataaaatttctcattgcccgtcaaaacaaaggaagcctattattacacttctttatgttttacttagattccattgtagcaaataccgtggatacaataagtaaccaataaatgtttgttgagagagtgaatggtatataattcaaataattgcagtaactaaaatttgacatttcaatatcatttaaaaattctacctagctcttcctggaattgttcttaataataaacgtgaccatcctgatgatctttaataattccaattttacccattagggtatccttatttacccaaaacaattaagggatttaaaattcagctttctaccacatagtttcttaactatctaaggtacatttagtcgattcctaaataattatacagtttctacatatgttgtatttattgcataaatttttctctttacactgagatttgcaaaagtgtctgatgatcttgggtcacaagataattatttctaatagcaaattattcctgcaattcagtgatattattgtacacgtaggtaattatcagagtaaggaactcagcctagggtaaaactagatctattatctagttaattggtatttatccaggagattacttcctaatcatgtagcagttattttaagggatttttaaaaaaagctttaatttatacttttgtagcaaccaggcagaatgaatggcaaattgtttttaagtgaatgccatcttaataaagataatttcccccaagtaaagcgttcataaatgaatatctttgtcctcaaggataatgtagaggcattttgaaatgcctcagttcacctggtctgttttttccctccagggtaagcagacagaatgtaagcttgctttctcggctatttcctgcatcctaactacataggaggataaattgactgatctacatacctgaattattattatatattctacttttcagtttgtttctgttttttgtttgtttgattttctttttatggctgctgtccagatgaagttaaattgtgtcacatctctggaaagaaaatagataacagataagaccgctctgcagttttgtgagactcatgcctaaaacatttttgttttagatattgattataacttcagtttctaaactaaaatctgaaagttgtatggcaaaatataccaagttatttgaaggacctaattagataattaatgtgtccgtgaactttttttttttaatgttctatatgataaattgatcctaaaatatctgggatgttaaactcagtaatgacacttttgcctattggcacagcccatagaaacaaaacattttagatgatttgcttctttttttcctaaggagactagacttatgcatgtttacaggttaattgaggtccagaaaggttaaataacttgctttcagttgcaaaataaggactggtgctgactctcctaaatccattctagtgttatagttgcaatgtcatgttactttttatgtattaaaggaaaatgaccttggtcataaattcaaatttcgctttagacactattttttgttaaaaaaaaaaaaaaaagaaatagaaatcttgcataccatcttcacatcctcaaaaagataaccatctattaaatgttcttgagattatgttgtcttatgcatcaagaataaatcaatagcagtgttttgaagaatatagtaatgtgaattctagagaatgctatgggatcagagaatacttagaacagtaatattcaaactgcagtgcatgaaacagtatcatcacctgggaccttctttgaaatgcagatttggagggcccttcccaaacctgctgaatcagaaacactgctggtgggcccaaaaatattttacaagcactctcggtgatacttatacaccataaaatttgagaaccctcgcactggcatgacaacagtggttctcatgcttcagcatgcgtcggagtcaccagagtttctaattctaataggcgtggagtggtgcccaagaattttaatttctaacaaggtcccacgtgattctgctgctactgatttagggcccacactttggaaatcagttcactggagtgtcttgtcatttacagtctgacccctgattctctttccttatgacagcccccataaaggggctttcacgtatgtccgtgtgaagagaccaccaaacaggctttgtgtgagcaacaaggctgtctatttcacctgggtgcaggcaggctgagtctgaaaagagagtcacggaagggagataggggtggggccgttttataggatttgggtgggtagtggaaaattacagtcaaaggggatttttctcttgtgggcaggggcgggggtcacaaggtgctcagtgggggaggttttgagccaggagaaggaatttcacaaggttaatcgctcggttaaggtggggcaaaaacaaatcacaatggtggaatgtcatcagttaaggcagcaaccgggcattttcacttcttttgtgattcttcagttgcttcaggccatctggacgtaaaggtgcaggtcataggggaaaggatggcttagcttgggctcagaggcctgacaggggccatctattcctgggcaggttaagggatgctactgttgcatcttgtgacaccttactgctttatgatgaaatgatctatccatatgcttgtttcatccactagaattaaagcttccctgggccaggatccatttcttgttcgttacctgtgtgatgtcttctgtgtagtagatgctcaattcaagctgtgaatagaaatgcactatattgagaactggtcctatgagatactatatctttggatgtctggctacagtagctatgtgaaaatgtattcttccagaatgcaaggcgtaaaagaatatcaacacgaaagaagacaggatcacattcccagagctgttacatataattttgttcgttttttgagtgaagaaaatggtactcatacttattcatctaaaaggagaagcatagttgagtgcaaataaaagtcagtttttaatcagaagacctgaactatctgtattcccttacggactcctgattctttcctttaccctctcatactctacatcgagcactgaaactgctctcagcaaggtcgccagagagctccttaattgccagctccaaaggtcactcttcagttcttttccctttttgacctttgtcttgtgcttgacagaaatgattagtcccttcttgaaatttttctctcctgcagtttctgggacattgttctctcctgttttctttcagagtatatcttccctgtcttctattcctgccctttaatgtcagtctacataagactcaaattgtgattttattttcttcttatgatgctttattttttggggaaatatcatttataatctttatcatcacctatatttttgattcacaaattgatatttctacctctccctctctcctgatgttcatccctgtataattcaaatgcttataggctatgtattcctggatttctgactggaatctaaaatatagttttggagtttagatcgtataactctagagagggtcattcacatcatagtctctaagaatggtacatcctgaacttgtgcagtgagcaacctgtgcagccattcacagtggtcttgatatctgccacatcactaaatccctccaaatgtacctgttaaattctctttagtttgttatttttttctacatccttgctgccttcactctagttaaaactgaaatttttctgtatgaaatttttaactgatttctctgcctctgatctcacctctcttatccatgctttttacagcctcccgagggatatcttaaaatgcagttttaattagattattcccctgcccataaatcttgaaatgcatggcgtagaaattcttttgtgatctttagctgcctacctctccagcttcactcccttctcctctgctccttttttaaaaaaaataccagtgctactccaaataatctgcaaactttttagtaccagtccacaattgagataagaagcttgagccagaatataaatcaatgtactccttcctttgtcaagaaagttcggcaattaaaagcaaaataagatcaaatcgtttgttcagtgactcagttgatttatactctggtgaaaactcttttcttcttacagactaatagcaaacagttcactgtctgctaaagtctgaactttgttccgcactgccctatgctttagcttaaattaaccactctttgatctccaaatgctctgtgctttcttaagcttctgtttctttgtacctactgttttctctgcctaagattctctttagatacctttctttttcccattcccatgttacctgccaccgtgctactaaccaccttgtctttctggttatctaaccttgcagaggcagttctcagccatttgtgtgttttttttttttttttttttttttggagacggagtctcactctgttgccagtctggagtgcagtggcgcgatctcagcttactgcatcctctgccccgtgggttcaagcgattgtcctgcctcagcctcccaagtagctggcactacaggcaagggccaccatgcccagctaatttttgtatttttagtagagatggggtttcaccgtgttggctaggatgggcttgatctgttgacctcatgatccgactgctaaggcctcccaaagtactgggattagaggcatgagccacagtgccaggccacttctcagcctttttaacacttctattaaaacacttgccaaattgtatggtaatgactttatttttgcatgcctgtatctccagtaaacgccttgagggaagaaatcatttcttgtcatctgtacacctataatgcataaagcagaagtcagctcatagtaggtattgaataaatatttattggatgttgatgagggattttccaggttttgtgcgagtcttgtcagaaaaacaaaatcactgtgatttaaagagaggaaacgtaatataaggaattggctaagcaggtagtagaaaactgagacgcagcgcaggggatggagaggcaactcaaagcactagtaacgtaaggaagctgctaatatccctagagctggagaaacaatacagaaaaagtgatattaccagagctcagaagctggggctttctaacagagattaaactaaagttaggactgccaggcagaaaattggattgttgaagagggagctagctatccagagaaaacagaagccacagcagagatacatctgctctagaaatgccacccaaggtagttggagaagaaaaaagaccttggcttttctcttcctcccaccttccaatattctgccattgcctccaaatgaacaattaggagggcaagtggtgttgggaaatgtatatccctctaatacagaaagtacagaagaaatgtggggaatagatctgagagcagatgggcatattactgcacagatgggttctggccgtgcatcttctgctcataaactatgtgacttaagccacttaatctccccaagaatctatttcgtcacccctgaaatggaatgtatatggccttccctgtttgccctcacactgtggaaattatattacatgtgtttgtcttgaagaacgtttacatttaaaaaacaatgtctcctttccccaggagaaagttgagtttccaattattaattcagggatggtatcttcccatgaccacatttatatattattcttattctgacatcttctgagagtattcttagtaaagtcttccctggtcagaaacctgtctctttacaaatgaacacatattatgctaccacagagatataaaaatgatgccaggctgggatggcctgaattgtgtcctccctaaattcttatattgaagctctaatctccaatgtgatggaatttggaaatggagactttggaagataatttgatttagatgaggtcatgaagatagggctcttctgaggagattagggcccttataagaagacacaacaaagagcttgctggctctttctccctgccttgggaggacacagcaagaaggaggttgtcttaggctgttcttgcactgttataaagaaatacctgcaactgagtgacttacatgaaaattgatttaactggctcacggttctgcaagctgtagaggaagcatggtggcgtctgcttctggggaggtctcaggaagctttcaatcatgatggaaggcaaaggggaaacagtcacatcacatggaagaatgggacaaggagagtgagacagtgcagggggaggtggcacacatttgtaagtgagttctctcaggagaactcactatcgcaaagacagcactaagccgtgagggatccgctcccatgatccaaacacctgccaccaggccccatttccagcactggagtttacaattcagcataagatttgggaagggacgaatatccaaactataccagaggctgtctacaagccaggaagaaggctgtcaccaggaactgatcctgctggtaccttaattttggaattgtagcctatagaactgcgagaaataagtggctgttggttaagccacccagtctatggtattttgttatgtaagtgctagctgactaaaaaccggctttgttaagcaatgagtattacttctgttttgactaaagttcatagtgatgcttactaacacagtagatggattgaaacaggtcatgatgctggcagtggggcattaagtacacgtcagattgaaatggctttccacattgcactagatccttttggaacccgggttggaagttatttaaacttgaaagacccacaagcatgttgacttctcttaaactcaaggacctttcacactgagagagtttaaagtttaaattgcctcccacagggtccaagtcatcatccaatgcatggtgggtttctttgaacacttctgtagtcattatgagtccacatcatttcaagaaagaagagacagcaacattagttttcatgctaattttcctattcactcaactaatatctaatggattgctatggtatgtaaaacactccagttactttaactgtaaatctaagctttccctcaggaagcttgcacccagcataaactgtcatgaagaagtactaataaaatgttagaaaagttttaaggaagaaaagttcacttcctgcttgagaggcatggaagacttatgggaaaattagcatctgactggataattaaagagtagggaagcattgggctcaagatgaggaaagtgacaattcattgcaggggaaagcctgtatgcgaacaaaacttacatgggattaagtattcttgtttgcctccagcagaagtatgaagtaaaggaagtttagaagtaaggaatgaggttgaaaaggtaggttgagttcataataactaaaggtattcaataaaagattaaggcatgtagacttaaaccttctggtcatggggagccattgcatatttttgagagagagaaatatgatatggctactgtgaaccatatcattttgatctcacttgagagttgggagagagaggccatcttaccttggtttcatagactgggaagggggaaagaaaagttttctctaaagggccagagagtaaatattttaggttttgtgtatcataaaatttattttaaaactactcaactctgctgctatagctagaaagcagccataaacaatgtataaatgaatgagcatgactgagttccagtaaaattttatttaccaaattagatggcagaccatatttgtcccatagaacatactttggggattccggcactaatgggtaaaatgagactattttgctgttgatttttgtttatatgtttcattgtctttgttatagctgtgtttgcagtttttattcttgttattccaattgtggcttttactttatcagtcattaagaagacactaaaacaaatatgactactctcacacgtgagaaagtgagaaatggcatagggcttaaagccagttaaaaaaggatcatggaagatattaataacaatagctaatatgtatatggcttctaccaagtatttgctacatattaatgtatttcacacttaaaatagcattacgaagtaagttttattattgtcactctttgccaatgataacaatgtgtcatagaaatttcaagtgacttgctcatggtcacatagtttacaggaagcatcgcagctaggatttgaacccagacagcctagcttagggtgttgccttcggaaattcctcgccttgctatgttgtaataagttaaaggtgatttcatcaaattatttagctgaaataaaatgcttgactgggactccttaagaatttgccaaagtctatggaagctgcacttattctagattatgtctgttctacattctgaagtatcattgactctagtgtcccatggcaacacttgattatctttaaatacagagacctttttcactgaaaagatttctttaaaatttagatgtctttttcagcatcaaaaataagtggaatttccatataattgaacttttttttccaagtgcaagacttttggagctcaccatggtcttaaccacattatataataagtagtaacttttttcatctatgcttaatattttctctgatgtgagaaattgtatcatcagattagaaagttgaggattttaggaaattaagggaaattccaaggtaataataaattgggaaataaattattttatattgccattagggtacaaagtatacaactaaggatcatattttaatgaaaaatttcagaattaatatcctgatattagagacttcaatcaaattctcatataatccaagatagcgtagtcaaaaccactaaattactgtactgtgtagcaatgaacagtaattctatattgacttatccttattttttttttaagatgggtttctcgtttatttggaacaaaagaaaaatgtagtgttgtagaaatctttggattcagacagacctgttcttgagtcttgactcagtgcttcactgtgtattgaaactaaatgaagatcttcaacttttctattcatgatcaatctgcaaaaataaaagctattacagataacatacaaggtttcttgagcgattaagttttctttttgaaagcctgtgacctgattaagatgcttaaaatgatatatatgtctcttttctgttctttaaatttgaatgaaagtttggcattttaaaaaactttaggtgatttaggagtataattttaagcagatttttagagtacgagtgtccacatatttaactaaacattcaaaaattagttaaaatcaatgaacttgggaaggaaaactacttgctacataatccagaaaattttactaaattatttgaactaagcatgactctccaaactgtggacatattttctcaagggattctatgtattatggcttcaaggtacttttgtgtgtacctcaaaatggctgaaggcattttaacagtgcatctgagagtgtcttacttacatattatttgtacactattttatctatatctttggacattttatatttctgtgtaagtaaaacttccatgaaaatttcatttgtcaccatattttcgttatgcagataagaaaacgaaagaagccaaattgaagacaagctctgaaagggaatgtgcgccctctagtgacccacatttatttatcataaggacataggcagcttttgggtttcatcattttaaataaactttacatttgattttaaaatatatgactcaggattttcaacttgagtatattatattgtatgatcatagatttattactctgacaggatttcatctatcatttaagagaatatttctattaacctgtgttaaggtgattttcttgcacagaagtgtgtttcaaagggactttcaatttattgaaaatgaaaaataggctttaggcatctgtggcttagcagcattttatttcccatcctctgggtcatgcagtttttgcccacgtgttttcacactccttggctttataactaattcctctaatgtagcagtatctgacattttagaatttgtgggggtttcttaccttttaatttttaaggttgtttctctcaaagatatttaaacaaaacttataaatgtgacatctgttcaatcatgtcacactttagaaataaatattaccaatgaattttgaaatgattaagatttaataccaaattaaggtaggaagattattttaacatcatttctacctaccagacgtcaaaatattttaggtaagttttactttgtgcagagaagcaatattttacagcagttttattctcttcactgcaatcaacgattctatgggtgccaagatgaatatcaataccaaataactcagacatttttggcattaatagcttaaaacattaaatcattcaatttgtatgcaagggcatgtattttaaaaagcagaatttttaaacatactaagtatataattcggtatgccataattgataataaagaagatgtacaattttaaggacaatattttgtgcttggactagaattcagcttttgaggcacatgttaaataggcatattttaggacaaggtaaacgccacagaaattgattttttagtatcttttaaagatgcctttcagtgcaatctgaaatcattaaattttactgtactgaaacatattattttatgagtgatgtgcttaaaattacacatataaaactagaaatacatttgagaccatgcaaatataaggaaaaatagatttttgataggaatgttaatatagcagtttccactaactgaagacagagtcctctgtcatctgtcacattgttccaggtgctgtgtaaaccactgaagagtttataggctttttattataactgggaattataacatctttagattttatttaatttgattgctagatgaatagactaatgtaattggaatatgaaagccacaatataagcaaagctgatctcagtttttgtatcttgggtcaaaacctctttaattagagaggtaagtaaacatatttacaagtaatttttaaaaagcatttgtattgtagacccagaaaatctgagacaggtctcagttaatttagaaagttgattttgcctaatcctaggtactcgggaggctgaggcacgagaattgcttgtccccaggaggcgggggttgcagtgagattgtgccactgcactccagcctgggtgatagaatgagactttgtctcaaaaaaaaaaaaaaaaaaaaaaaaaaaaaaaaaaaaagttgatttttgccaaggtggaattcgcgcgcctgtgacacagcctcaggaagtcctgacgacatgtgcccaaggtggttggggtgcagcttggttttacacattttagggaggcatgagacatcaatcaagtacatttaagaaatacattggtttgacctggcgcggtggctcacacctgtaatcccagcactttgggaggctgagtcgggcggatcacaaggtcaggagatcgagaccatcctggctgaaacagtgaaaccccgtctctatgaaaaatagggaaaaaaaattagccagacgtggcggcaggcgcctgtagtcccagctactcgggaggctgaggcaggagaatggtgtgaacctgggaggcggaggttgcagtgagccaagattgtgtcactgcactccagcttgggcaacagagcgagactccgtctgaaaaaaataaaattaaaaaaaaaaaaaaaaaaaagaaatacattggtttggtccagaaaggcaggacaactgggtgggggtgggggcttccaggctgtaggtaaatttaaacattttctggttgacaattggttgagtttgtctaaagacctgggatcaatagaaaggaatgtttgggttgagataagacattgtggataccaaagttttatcatgtagatgaagcttttagctagcaggcttcagagagaagaggctgtagagtgcttcttatcagacttaaagtctgtgttgatgtaagtgtcagagaggtataatgaggcatgtctgacccccacttcccttcttggcctgaaccagtctttcaggttaaattttaagagccctggctgaggaggaagtccctttggagggggagttagccttttatttttggtttacagtatgtttttacttcaggaccagtttgataacagcttttaaatttttacaatttaaagcaagaagtcgctgaagatcgaagaaattaatttacccaagaaaataccagaaagataaaaattagggattaaaacctgtggtgcctgatttacacacacatatatagctatgttatttttttttcttttttgagactgagtctcgttctgttgcccaggctggaatgtagtggcacaatcttggctcactgcaacttctgcctccctggttcaagcaattctcctgcctcagcctcccgagtagctgggattacaggtgcccaccaccacagctggctaatttttgtatttttagtagagacggggtttcgtcatggtggccaggttggtcctgaactcctgacctcaagtgaactgcccgcctcggcctctcaaagtgctggaattacaggcatgagccgccacgcctggccctcagctcagtatatttttaaatgcacatttactttacatttaaagcaacttaaacatacacacaaacacacacgtatcacacatattacaaaatacaagacaatcatgtggccctatcttccccccttccacagagggagacacacttacactatacaaacgtgtatgtgttgtgtgtgtgtatacaaactatcttgatttggagagggaactatttatctaaatattagcttgttttcttttggttaaataggatttcccctttaataatattctgtaattccaaaaatataataattgccatgtagtcaatgcatctcaaagtcctaaaaatatttttagaactaataggatttatactgaatttcatttgatatttttataagatctatttgatgcaaattgaatttgtattctattactcgatttttttttaaagcaaatgccatgtggaaacaagcagagagggacaagttttcccagaaggaaagttgaaaggggaagagtagagagaggttgatcaagaaaaccttcacagatgatgtgcatcttgaactgagccttggaagatgaatagtaggtcatcttcaaatggttggggatttagggtcaggaaagtgcctgtatagtaatatggaattaaaatgtcttctcacttcggaaaactctgaagaagaaaggtgatttttaaaaatacagcaaagttggaaaatcttacctccaaaattatttcttctttaataccaacaaagaataattatagttttgttcctattaatgttaaaacttgcttcctagctaattaaaatgttcattaagaattggtttcataaattatctggtctaggcctagagccctgggaccctgcaatggttaacgtatttcacaggcatcagcattttcctttcaggtttctaaggatgaggcttataagtttttatgaaattctacatgctaagatgtttaaatatgtaaaatggccattcataaacctagttcactaatcaaattagttaagtctgggagcttggaggacttccactctcaaagtttacacatttgggaatgatgagttgcaacttgtatattgaaagtgactgaattaaaatttatgtaaatgtgtcatcttagtttaataggttatgtggcagtcactgtaaagaaaattaacagaacacagtgcccatcaggaggctcttctgacataattagcacagttatatagcactaattcatgtaatgttttactattgacaattcaaaattgacaacttcttaaatggcaaacatttctctagttctttgagatgtttgtatgtgtttttgcctttgaatttattttaaacatttatatacacaggtatctctcagtatttaccatatgggatgtaattaacctaatttacatcatttttatgggaaattcaactggatgaggctgagtctgtttgtacaatataatactgagaaaaattgtcactctctgaatatttggtatatatgccccaggcttttgatattttgaaacttccaaaaaatggaaggtctttttgaaaaattgtcttggtgtagtaatacacttttgccaagaaaaaaaaaaatcaaagacttacttgccctgtatgatgggactttacaagttttaatttcaggggtttctgatgagtatatttgtaaaggagaaaaaaattgtcgcttcactgctaaccataaataataacaaattgaggttttaagatatacttgaagaatagaggacagaatattcatcaataattatagaaataatcattttgtgaacagagaatgagaagttatttttttattagctaaaggagattttaagctaggtaaagttagactgcatttaagggatagagtctgataacattcggaagtacgttaagtacagagttaagtatatgaggaaagtaagttaagcactaaggaatatattagtggactgattccaaaggtgtagggacacattatgagcaacttatgatacataagttcattagcaatggttttatgtgagttgttaaagtggggaaaaaagaattattagaaacgagtaattttatgaagaagcaaaaatacatgtacagaatccaacgttgaatatggcattgaaaataagtcttcagtgttttccttgagggttttaaagaaggtaactgagttgcatctgaatgatatatttcgttcgtaattaaatacccaggctcacttagtgcaaagtatgatagaaaatgccatctgcaaagcactgggaagagtagatagcacccaatttaaagcatgaagacatttaaatcagaggtgtctgttcatttgccatgcatctcagcaaagatatctgaggaatatctagtagcagtgaaatacatgaaaactacacgacaaaccacaaaaagtgatgaagcgatagttgctaaattgataaggaataaaataaacgtgcaattgcttcttggaagccagggtctgagtaggatccgggaaggagactgagttcattgtgcattgaaaatgtcactgaacctaaaactaagcgttggatgtaggccattggcactcagggagagtacatgggaggccttgaaaccctgcctctgcttcctcttcacccttccatcctcattgctggcataaagagatgaggctatccactggcagaatattggagagaaaacaatgctagtagctgacagttaactcccagaactctaagagatggtggtacatgttaagtattagagtgtaggctgactgcacattatgtgtggacaaaaagagttttagcaaggaaatcagagatgtttgaaggaagaagtccaaatggaagcaacataaaataaatattaagattaggttaggaatagctcagagcttgaattgtgtaagaattgggttcagtgtccacctgtttcccatgaaatcaagatatcacaataatgatagaaatgaaagggaagaactccaacaggtgagaagagtccaaactcattaatatgtttctttgttccattttagaaaagaagtataacattaacctctgtgcttatgaataggttattttccttagacaaaacgctctcctcaccactgccctagtaaaatttgaaattgcctttttaaaaatctgtacatcaaaaaacgagcgtaatcactctccatacgatctttgtataaaagggaagttcacgcactgtatgtgacccctttccaaatttataaagtcagacaaaaaattgaatgaggaaagacctttctgtagaatttcacatcctgttgtttgaattgatttgaattatcagaactacgtgccaactggtgtccaggcctcccttaaaatcttcacagacagagaagcaaacagacagttaccatggtgttgactccacaaagccttctttgtgtggagataaccaatatacttggcagagcctctaggctagaagctgatttaatcctaatttacagagaaggtgttttttgattatcctcttaaaaagaccagtgtgagctgagccccagttctgtgtctaaaccatttttatcttgtcaaacaaatgcttcactaaaccaaattacttgataatgtggactaatgcattctcgtctctgttctttatggagttaatagcatgtctggcacatagtaagcacttagtatatgctttatgaaggggaaaaaaaggagacatttgaccgttttaaaaggaaacatacaattttgcctttttcaggaaaatacacctctaaaagtgttacaagatttcttctggggccgggcgcggtggctcacgcctgtaatcccagcactttgggaggccgaggcgggcggatctagaggtcaggagatcgagaccatcctggctaacacggtgaaaccacatctctactaaaaatacaaaaaaaattagccgggcgtggtggcgggcgcctgtggtcccagctactcgggaggctgaggcaggagaatggcgtgaacctgggaggcggagcttgcagtgagccgagatcgcgccactgcactccaggctgggtgacagagcaagactccgtctcaaaaaaaaaaaaaaaaaagatttcttttggaatgaaaattatttactttcaaactaaaaacaaacaactttgtttcttttttctgcagtgaattggaggtggtggtataacagttacatcaacatgcatgttataggagcagaaaggctgtgatccctttccttcctccttatacaggtcatagcagacattcctataacaaaagataggttaacaagagaaaagcatgagatatttatctaataaaagttttaggtgacatgggagccttcaaaaatgaagacccaatgacccaaaggaaaactgtttttatgcttagagttgataaagagtagacagccatgtaggaatgtgattggacaaaaagggaatgatctgatagtaatagactagggacaaccagccaggcctgtctgtgtagaattccttcctcctacacatggggtaggaccccacttgaatgagggtcttatgatctactatcaaacaaaagtatgtcagagaattttttatggctagctaatagagagaaaggtgggcaaaatacagagttataattctggcttttatggttggctttggaggagagggtttttggtttctatgacctaccttgaagaagaagaattctggttactatgactcacttcagggaagaatgtggagttaaagacaggaggggaggagaaggtcagagggaccttggttttgaggctgcttttgaggccttccagtgttctttagttcaaagtttcagcatgccaaagtgccatactttggggtatcgttttctgagcccctacagtgtgcaaacaagagcaatgtcaattcaacgcctagtagaaatctttctccaacataggcttcagcagatttctttcagctgtcatgccagcctagtaccttgaggcacgtttgagtttcagggacctctaagtagaagtgagcaatctttcttagagatagtctaaatcaaatgagggtgagactagagagattaagtttaaagcgtgaatttgaaagtgactggtggatattcctatctcatatttatgagtcagagggtatttgatgtataattgagtcagacaaataaatttcaccaaagtggcccaaatgcattatattaacaacccagttttcaaaatatttatggaagagtcagtgaaggattttattccattggaggaggaacaagaataaagaatagctctgaattactttagaaaatatgaagcgaaatttgtttctacaagtacttgaataaaagacaaagtagaatatacagttaagaggtctatgaaggccagattataaaggatcatgttgaaattttgttctttattctaagaaaaatgagaaagtctttgagtggttttacgaatgaaggtaacataatcagatatgtttttactaccgtatatttcaaagtagctagaagagaataatttgaatgtatctagcatagacaaatatttaagattatggatatcccaagtacactgatgcgatctttacaaattatacggatatgttaaattatcacatgtacccccaatctaagtacatctattatgcgtcaattaaaaaagatagaaatgataatttttccagtagtacataaaagagagagttccataaatactgcccagaggccaagtgaaaagctattgcggtatttttggtcacatttaatggcaacacagatttgggttctggctatggagacaggaagaagcatacatattcaggagacagagaatgtatgtgtgacagattagactttgcaatacattaaacatgggaaggaagagagagggttttagttggtttgctgtaacaaaataccataaactgggtagcttataaaccacagaaatttatgtctcccatttctggagtttgggaagtttaatatcaagtaactagcagatttagtgtcttttaagggcaggcttcctggttcatacttggtgctctctcactgtgccctcacacggtggaaaagaacactgatctcttcagatcattttaaggggactcatttcatgagggctctaccctcttgacctaattacctcccaaatgccccatcttttaatatcatcacattgggaattaggcttcaacatacgaacttttgtggggcacaaaattcagtccatagcggagatgaagataacaaatatgagggatggtgatgctaattactgatctggggaatactgatagagtactagtttgagggagaagatcaaactttaaaccttggcatataatgtttaaggagattttgcagcatgcaagtggagacatccaataggcagatggttatatagctgtggaattcagaacaagtgcctgaattagagatatacatatcagaatcattgataaatagattgcaattcaaggcatgatgactgatgtgttttctggtgagagatagtagagtagaagatgattggtaatgaactaggtcttgacatctagtacataatgatagggtggaggaggatggacctgcaaagaaaaaattaccaatggtcatagaaatagaaggcaaattagaatagagtggcatcatgaagccaaaggaagaaaaattacaaacggatagtatggtcaacagtgttaactgtagtcctagctacttgggaggctgaggcaggggaattccttgaacccgggaggcagaggttgtggtgagaccagattgcaccactgcactccagcctggtgacagagtgagactccgtctcaaaataaacaaatactagaaattggatggactcagatgcttgagcaaaagtaagagaataaagttcaaaatgtaggtagtgggaatgactttaattaaaagaagggaaactcaaatgtaaaagaagggaatgagaacggtggctacatatgcgggtctgatggtgtttggaaataggaagtgaaagaagttctactctgataattgcacttgtttctgtaaggtagggaacaagatcatctgagagagctgcagaaagaggatgggccagagctttgataaaaggttttaatagttcctgtagagacttagagcccaacttgggaaaaaaaaaaaaaaaaaaaagtatggcaggatgctaggttcatttgaggctgttgattattgccttagtttgggttgccccaagagtagatctgaagagaaggatttaggtgcaagcagtttatttggaaagtgatcccaggaaacaaagtagggaagtgaaataagaaaaataaagcagccaataaagtatggcacaaatatagggatcaggttactgctggaaggaactggggctcaatcatgcagggaaccccttgagacactgtgtatcatacttcaggattgtccaactgaggggcaagggagctgggaaattcaccaattccaagctctcactggttaagggacacccctaaagtattaacattccagcactccttctctgtccaatatactggcaaatagatgcttgcagatagagagacacaggaaattttatgttgggccaaagcaaaaataaaaatgttttaagacattatgatgataaatatgcataaaagatgattgaaatataattcactggtttgggtaggtaatcaaataaccatagtaggagagtatttaaggagttaacatcgctgaagagagtgtgaaagatttttacagcatataattgtactgtatattttaatcaacattatgaatgaagaaacaggaacctgatagtcaaacttgtggataaaaaatgtaggaaagataaaaatcatatatgacacaataaaaatccataaacatttgtaatgcatacacagataacttactgacattcagtgacatgggatttagaggaatcaggatccctagtctcttaatttcaagttggatagcctcgataaataacaactcaatctgtatgctatgaaccgtcaagtttctgacccatggtattgaggtcaattaacttaatttctctgaagctccatctcatcctatgggcagctggaattggtgatacctaaccaaagaattttgtgagaatataaaatgcgaatatgtttttctaagggctttgtgttccattaatttctgtatctgtttaatttttaaacaatagcctgcaacaaatgtgagaaattctaactggtttatatgattcaaagtcccaaaactggagttcaatagatcaggtcatatgtttgtgatagtaattaggttgtgatataactggtttaatgatagtttatgtgaaaaaattcctagaagttttaagtcaattgaattgcaatgtgagttgaaagtctaatattgaagtgaaaatatttattgaaatcatgggctatatcaatgaaagtattataaaccagaaagataattattcttccctgtttattttacacactgctgatatgttccctttaagtacccaatttaaggaaactaagataacaacaagccatagaatatccgttgaagtaattaagcatagggtaggctgatgatcaggtatctactgataaatttaaagagcggatttcaaatatttataattttgtatccttttgccaatatctttccaactactctccacccccaccagctcctggaaatgaacattgtcttctgtttcttttagtttgatttttttttttttttttttttagattccacttgtaagtgagatcatgtggtatttgtctttctacacctggcttatttcacttaacataatttcctccgggttcatacatgttgttgcaaatgaaaggctattcatagtcttaaaggcttaatactattccattagacacttgggttgattccatattttggctcttctatacctaaatcaccagattagaatgaataatttatccctggtggctccaaagatctcttccaaaaaaaaaaaaaaaaaaaaaaaaaaaggtttgaaaataacaggataggtgatctgatatttatggcagcataacaactcacaccaaaatgtagtggcttaaaacagcacctatttattatttctcctaattcttcaacgtaggcagtgccctttgggtatttcttttctctatgtggcatcaactggagcactcatttgtctgtcttcagctggcattgagatgggtcacagagggctttatttgcatgcctggtgccccatgcttcttcatgtggcctcttcacatggacagatcaagtttccttaaaacatgatcacctcaaggtcattgtacttcttatataattgttgtcttctcagaatgtgtgctctaaaaagtcaagctctgacatgcaagcacttctcaaaaccttacttgcagtactcttactattgtcccatttgtgatagaaagtcacgtggccaaacccagaggcagtatgattggagactacagaaaagcatgtgtttcaatggtgaccaccaacaggaattttttttttctcataaatactttccaaaaagaaaaggttatcgtgggaagtagtactttttcaaatagtggaaacattcaagcagaggctgggtaatagcttacaggatatattgtagaagtgatttttacattgaggtgaataaaatgacctctgtgatcataagactctagatcaaagctgactccaaatttgagtctacctaacagggaaaatagtgctgctattaatactaatagaggtgtcaggcaggagtctcagattgagaaaagaatgataaatgtggataaattgctttttttaatatagaagaaagagataatcaagaaataatgacttttattttttgctgtcttaggttggatgttgatataactgaacttcacagctggattactcgctcagaagctgtgttgcagagtcctgaatttgcaatctttcggaaggaaggcaacttctcagacttaaaagaaaaagtcaatgtaggttatgcattaatttttatatctgtactcattttgtgctgcttgtaaactccgtgctttgttatctgtgattctactagttgatagattaatgcgatatgataaaatgctgtttaatatgtcttaaaaatatattttagatagcaagcaaaatcaaagtttagcctagagaaatctttctggattcttctgtgactgactagggatgcctttcataaacttgccttaacttacatattatttaactataaattaacaattttatgacattaattcatgttgattcctttcatatattgttcagttacctcaaggctaggccttagcaagcttgcacaattgtgtagagtagaatagagtaaaatagaatagaataatataatagataccatacttaggactatgtctatattctcactgttatcaaaaagttattctttatagtcatcaatccctgtcatatattataagatatttaaatttcccagatatttgtgtattaccttatctaaaaggtgtccagcctttctcagtatttacatgtggtagcagatgctttgttgttgttattcccttctgagatggtataattttgaccttcacaaataggaagttttattaatttaatataaagtgtttcatctttagggaaattgtcaaggctttaatttttcaacttcaacaattataaaacatgcatctttgtatatgattggcaacagtttgtaaaataatttctaacaggcagagtaaataaaatgggcaagctaaggaagcagtgattatgaatgaaaagtaattttatccatgggaagatcacatctaaatgtgtatattagctctgctttttctctccaggattcaaatcatgaagttcaaaatccattgtatttttacaaatacgacattacctcagttacaagctaatgtttgctgttggggttggaacttttggagatcaacaaaagatatatatatattctggaaaaaaaatctattttttaggctgcttgaaaaagggaagacaattttgtcaccagttcttcttagagttaactacttataaattggaaagctattttaaattacttattagctttataagacatgctgttgtcagcattataatagactattctaaattgtttcaagaaatgggaaatatgaaaactgaaagataatatataattgtagaaaattagctaaatgtcttttttcaagtatacttctttgaaggtaaattgtttgctgtgatttttgagggaaattctcttagtagtagaaaattaattagagaacattaaactctaattttcaaacatcatgttacatatttgaccactgaaagtatgaatcacctttagcattttattagctaattaaaaatgattattgatctgattctcacaggtttctgtctgatactctgtttctttatcttaagacagctttgatcaggcaggaaaattgagtttcagtatttcaggaatataaattttaaaagttcctgttatcatgtggttacctatgaacgatttgcattttatcaatagcgggagcatgacagactaaaagtgctcaaaaatgtacagtgttttataactggttttctgataccttgtgagtcccctttatcaacctgaactctcattttctgaaataacaacatcattcttaattgcctactaaaatgggacatgaaatgatttaccttgatgtttccctcaggctaaatacaatgtatatgtattaaaaatccttgagagaaatacataattacgatgatggatattcagtttaggtatccattaattttcttactacatcacctgtcggtttatataggttattttaaactcatggcaggctcgtgtcatgaacttgagtggtattaatccatttttaggctttcattaaaaatggctaaatattaccaactcttttttttttcacttgatttcttcatttactcctttcaaatgcttttagccagttagcatatcataggccattatcagttcaatttcacatattttaaaaaatgcaacttttaaacctaagcataattttttccttgtatattcaccatgtgttttattcatataattaacaaaatgcacttatttaaaagctgacttctgggggacctttctaatcaaaatgtccctggaccaccaatattgacattatctgggagcttgtcagaaatatagaatctcagaactagtaaatcaaaatttgcctttgaacattttccaggagtgattcctatgcacataaaggctcgagaatcaatattctaggacacaatcttgggctttacgtagcagttacctctcacattcttttagtatcactgcagttcagactttttagctgaattaacagattctaacaactcgaattttttccgtgagcacatggtaacgcaaattggtaatgaaacaaacaaaaaaaatagcctcctttgatcacaaggggatttgataaggtgtctgaaaatctggagcttctgtgaggttctcttgaaaccctccctatcaagtcgttatggtcatctggctttgggctcttcctcggatctgcacttgattaccctctttcagaatcaactttttaccaactcccgctggaaatcatcaagccagttaatgcttccaatttctcctatctctgttatctgtgtttactacccagagtataggtacctcgagtctatattttcttctatctttctctctctgctctattgcactttcttttccttgcttcacttcctctgctttcccacactctcactcggcaggctcaaacactttttcaagacaagccttctatatacttattctactcatacgtggaaaccaattttaccctcgaaaacagcactatgactcatccctcttttgtacccccactactttagaatgactgactccctcacctaacagagacaattccaaagatactgctctcttcatgtaaaaatacctctttccttgcagttaatgacttctggccatctcttatctaccattttatcatattttctcattgaagactttggcactaggttagtagattttttcaaccaatttgttctttcattcttagttatttcagcatccctgtgggctctcctgctatcactaaaagctgttgtttctctcatctcctcaattcagctacctgctgtcatgattgtatgtatgtagatgttgtcattgtcaggcattactccatttctttaataagattatttttttgagacggagtctcgctctgtcccaggcgggagtgcagtggcgcgatctcggctcactgcaagctctgcctcccgggttcacgccgttctcctgcctcagcctcctgagtagctgggactacaggcgcccgccaccacacccggctaagtttttgtatttttagtagagacggggtttcaccgtgttagccaggatggtctcgatctcctgacctcgtgatccgcccgcctcggcctcccaaagtgctgggattacaggcgtgagccaccgcgcccggcactaacaacatattttaacaaaaccagcagttcttcataagctttccgtgcatcctaagtatattttcaacttagtttctctcaacaattatttcaagcttttgtggggtacctaaactttccccatcattcacagtaaatgatttcatctcctactttagtcgaaataatatttctcaaattgtgggtatttgtgctcatagtatcttttttttttttttttttccacctgccttagtggaagaggctatccttcacctggttgaggctcatctctgggtgtgtgttctcagcagcatcactgactatgtattaagccacctggttccattcagctgtatatccagattgtcaaaaatctacatcccaggtctttatcattagcttttaaaccggttgtgttttcatcttttagaacgtgtcctctcctataaacatgcatgtgaatacttaacgtgccttatcttactcaatccctctgtagaactagaacctattaacctcttttccctcatgaaattctttcctcgcttggcttatgggatactgctttctcctgattaattctttcacattcttggccatttgttccaattcagtttttctttaatattgatattcttcagagtccttgtgtttcttctctggatatcctcattcattcccattcaaatagtgtctattttcaaatgaacccttctcccatatgtatctttagctcatctctttcttaaaacccagggtgatatatctgactgcctaatagacaattttaattgatgtttgcctgatatcttaaatctcattatttccccagacctcctttattctttctccttcctttcaccctgcaaacagcctaatccagaaacctgaaagtgaactgggtcacctagatttttcttctaccattcacaagtccaatctttgacaggttcaattaatcctgctcccttaacagctcttgaaaatgtccagttctctctattcccatcaccaaaaccctgattaaagctaatatcatggcttacttctatttaagatgacaatcctgtagctggtcttccctgctactaatgttatattcctttagaagtttccacatcacctctgccaaagcgaacatattaaaacctcagtatgatcttgttatgtctgtgtttataatcatttgagaaagataaaatcagctactgatagccaggagctggcttggcacttcagttaggctttggaactgctagatgttgccttggtacttgcagccagtctgatgttctctggttgaatataaataattgctagggatgccagcatcatacagggacacgctatggttgtgatgaatcaagataaaagcaagaccactttgtaatcatatcttaatacagtaaaaaagaatagcattgtccaaaccacgcctaatgaccaaatatccctcatcttcattaatgtgacacattatgcttctttactaaacacagctttagcctctctgcattcctcctgccatctagataaaaattttaggacactcaacatagaattaccctacttccttacaacatccaatcaaaacaaagccccacttccttgatgccccctatcatgtaacacaagcccacatcttaaaataagctttttctaacatactcttagagacagccccatagttccctgtgatgcgctgtctctctcgttgcagcgtgtaaatcaggttaactttgataacctacaaatatgttccagtggtctttgtctgaagagtgttgacaaagtccatgtcttcatattgccctcttaaagcctacaatgatctaatttttgtttacttgcacaaactaatttctagccattttcatttcaattccattgttggtttctagaaatcaggacttgaacgtgaagtggctttggttttatgtgtgtgtgttttgtttttggtgtccccatgcctaacacacaaaccaataaatgtttaactatatggatatgtgatttttttcagttctgcagttgcatttaagataggatctattaccaatatgaaggatagaacaacttctgaataaacatttgagtgaataagttactcttcagtcaaagggtaaaacttcattatagaatgttaaatgagtagattcttaattacttctaatgtcggagtaggactgatagagatccataacttattttcataatgttagagaagatacagaaagaggaggcttttaagaggtgctaataaagaaggaggaacagaggtctgaaagaggttttaatcaacttattgaggaatttgtgaacttccctgtgttgtattctttgcttcaaattattttacttttcttccttttattgaatattatataacttagttgccttttattttgcatttaggttacccattttagtatttataattcttcatgatctctaagaattttcatgagcccacaataatcactcatttctgatacattgatttactgatgccttttttagcttctgtatactttacttgaaattatgtgtactaaataatttagaatccgagtagtggcttctaaacatgtgatcatatattaagcatatattgagtaaagtatttagtattctatatgttaatagcataatttaaaaactgtatgttatgaaatatagatcctttcaagattaaaaatgtatatgcatgtagacacatatatgataaacagctctatagaaaaacacacatacagaaaagctggatgacttcatgaggacgaaatttaagagaaagataatattgtcaagggcagaggtatttttatgaacatggcaatttcgaggaggtaattgtagtttttatcagtactgaatgttgtaagaagcatttttcctaacaagaagaaaattaatgactttcttttctttttttttttttttttttttttcccgagacggagcctcgctctgtcacccaggctggagtgcagtggcgcaatcttggctcactgcaacttctgtctcccgggttcaagcgattctcctgcctcagcctcccgagtagctgggactacaggcacgtgccaccacgtccagctaattttttgtatttttagtagagacggggtttcaactgttggccaggatggtctccatctcctgaccttgtgatccacctgccttggcctcccaaagtgctgggattacaggcgtgagcccctgcgcccggccaaattaatgactttcacaaaataactttttgtacagtagtgaaggctgaagtctgactgtaggtatttggagtaatattgaaatactggaatttggactaatatggtaatattagtccaaatttcattgaagatgaaatatataaaagaaaatgaagactgtggttgaagagtattcagatgatacccttggtcttgaaaacatgggaaaggggtatatatacagtatgtatgtgtatgtacatatatgtacatacacacacatagagagaggaggtggaagatcagagccatgaaataaaaacagagaggtaagattctaccaagttttgactcatggattgtatatggtactctttcttttctacttaggtattggtttattaccagtatcaggacttgagctgaagaaaagatggatgtgcccaactccctaactaatatgcagtttctagaatactttgatttaatccatccttcctttactgagcttgcagcacctgtccccatgtactggttttatggccactttatataaagctattagagttcgttatgaatttgcactttaagagagcattgtgggtaaggggagagaccataatattgtatatggacgcgttacgctaaaatagagctcgccttattatgtacctataatgtaccagccactttcatggagacttgggatagagtagagaaggatatagataaggatacctgaccttatatagtttacattctagtgggaaagatggaaatgaagcaagactaatatgtaaagcatgtggaatgttagtgataagttccaaggagcagaataaaatgagagggtatgcatgtgcttgtagacagagtggcactaaaaggcctagctgaaaaagtggcatttgatgggggaaaatgtccaagtaagtaatttagggcctttttaggcatggggaaaaataaatgcacagccgtgtaacagcagcatgcctgtagcatcagggaaaaggtaagcgtgtggctgcagcagaaaaatcacgatgtttagcagcagaagaattcagaaaggttaaggaagttaattaagatcagaccatggtaaggacttgagcttttattcagctgtcagcgagttgagctgaatcctgttgtctctgtctgctgtgttgataatatataatcagagaacaaagggtgaaatataaagacctttagtatcctattttgaaacattcatacccctcagagatgatggggtactttgtctaatgtggtagtagtgagcaccatgataactcactttctggctatgttttgaggttagagccaacaggactttgtgatggattgaatgtgaggcttgagagagagaggggagtggaggattctgtttttggcctaaacaaaggaaaacacagattgaggcctaggacactccaaagtgcgagctcagggacatgattaggaacctgcaaaggagatggaggaaaggtgacctctgaagttggaggaaaactgtgttcaagtagtacgtgaagccaaattagcaaatacttctaagaagaaaaaggaatcctctcaatcaaatcatggtgataggtaaagtgagaactgaacatcagtcattgaatgcagtagcttgggggccaatggtgagactgataagagcagttttgatgggactgagtaagagaatagatgtgagagccagtttttgtttttgttttgaaccagtttttactttgcaagatagacctgtggaaggcctatgttcctctttgttgatacacagtcacttaaaatgaggacagttatcttcctttttcagcaaaatatatctctttagactttgtttttggtttttgtgcttttctgtgctttttaatgtatatttctgtgagttaatgggagacggtagaaattttaggaactactgatccaacctacctgaaaacagaagttcatatatttcatttgaggacgaacgtatgggtggccagatcccaggagaaatggcgattttcagtgatgtttatttacttaacctttttttttttttttttttaacactttttatatgtggttatttggacatttccacgaacaaggtactctcatcatctcttgtgtcaaaaatgtttccgtggccaggcacggtggctcacgcctgtaatctcagcactttgggaggtcgaggcgggtggatcatgaagtcaggagatcaagaccatcatggttgacaccatgaagcctcgtctctactaaaaatacaaaaaattagccgggcatggttgcgggcgcctgtagtcccagctactcaggaggctgaggaaggagaatggcgtgaacccgggaggcggagcttgcagtgagccaagattgcgccactgcactccagcctgggcgacagagcgagactccgtctcaaaaagaaaaaaaaaaaaagtttcctaaatttctttttaagattattgaagttacctttaagtagaatgagcacatatttcagtttgtcgggtatagtcttagcttatgtcaaaccatttttctcagcttaattattcctagctccccattttactataaaaactatctcattttgggaaataaatagcgagcttcctttaatcccctcagaagtcccacatggtaggtatctttattgctattttacataggaaatactgaggttcagaaaggtcgaagtactttattagggacagatagtaagcagtagagacagaactgataacagcagagcaaaaagggtgactgcaggcccttttgttgtagtatcttctttaacatctctttgttatactaaattttattatttttaatcaactatctacagctgtgtctgaaatgaaatgttttctgggctcttcactgtctcattcacactcttcaaggcatacttgtatgcatattcctcttcattttgcaatgttcctcttgaaagtaatgtgccctaacagaacccagatatcgtctgaacattgacaaatatgcagataccattgactgcttctttctggggtctatgtgtctctttatgcaccagttattcagtttatttgagctgtatacagagttggtaatcagcctatagactgtcagagaccattctgagtgacccggcattccttgtgatatcttgttggccctgctgaattaatagttaaatatgttgaacatccctaatacatccaaactataagctctgtttgctctgatatatattctgatacgctcacacctttttgaataatatccattgaaatacccctagcaacagcagagcatgtctgaaagaaagctgaaattataagtagaagagcagggttctaatattgaatctaaaacttcctaatatgatgacctttgatatacgatttaatcttactgatgctcagttttctcttgtataaaatggtatacaacaatgctgatttcttctttcttacaattattatgacatacatatggaaattatgtacataaactataatttggtagtataaggaatcttattttcaatgtggctattgcattgttttcaaaattttcacaaacctctctgtgcctcacttccctcctctgtcaaaatgggaaagtaatagtacctactttatagattattgtttttgttgtagttgtggtggttgttactgagactatttatattagaataactggaacaatgtggttaacaagatattaaaggtcaaatatgattcctgagatattcaaatataagttttgttctctgttagtaatattaattgattctagtaagcttagaataaagagattatgatgataacatttagagggctattgataatttattttcaatatttataaagaccacatagtgttctcattctactttttatatcatttcacaaaaactaaagcaaaagctcaatgtagataaaatagaaacccctctgataggagaagataactctaaaagtaactcaaagaacatcactttactcagcttgttgtcattgttcctttatgtgttgtattgtggtatatattttttctttcatctgtatattgttttctggataaagttcaaattctggacaccccaaatcctcctgtctttcttgatatttacattacatatttacttaaatgtgcttattttttctcctctaagatgctcagggtgctttccatataacatttaccttttaatggagaataaatgtaagtagtgaaaaacaagtatgccataagctgctaaggacagataacttagatcacaaaaactaataagttgagaaaatagaaatattggagcttcatctaggatcttacttttaactagatgttgtagctactctattttcatggacttttcagttcaaccaacaaattagaaccatccatgattgtgcacgttcctggaaacaattcaatactgtctttgtgaaactgaatttcaagacaactcagaagttttacctgctaattggaaagggatcctgggaacataaaatcacaaaataccacaaactgggtgctttgaaattttcaagtggaatgtaagatattaaaaagtgtctgtcactttcagagtttcttaactaattagacaaaactgagttttcatttgttgcccttcagagcaccatgtaaaatgtgtatctttcagctaagagataggtatttaagaaaataaaacaaaattactaccttatagattttttttaaattttactcttaatttattctcagttttaattagtattttatatattacagctattcctgatggagtttattctgtgaatgattggcttttttttttttttttagcattttgtactcttgatattgaatccagtattcctaattcatgaaacctttttttgtgattttaatagactccatttttagagtaattataggttcacagcacaattgaacagaaggtacaaaaatttcccatataacccggctcccacagatacatagcctgccccactgtcaacatttcccactagagtggtatatttgtttcaacagatgaacttacattgacacatcattatctcccaaagttcatagtttatacattagctttccctattggtgccacacattctgtgagtttaaacaaatttacaatgacatgtatttatctttagagtgttatgcggtgtaatttcactgccataaaaatcctcaatacttttcccgttcatctacacttctctcctaatctctagaaaccactgattgttttgtagtttacatagttttaccttttccagactatcatatattcggaattggaatctagggtgaaatcctgcggtaaaatatatagccttttcagattatcttctttaacttagtaacatgcatttaagttcttccatgtctttttatggcttgatagctcatttttaagcactgaataatattccattgtctggatgtctcacagtttatttatccattcatctactgaagaacatcttgattgtttccaagtcttggcaaatacaaacaaagctgctgcagcattcatgtgcaggaatttgagtggacatatgactcctttgtgtaaatgcctaagtgcatgattgctggatcatatagtagaatgtttacttttgtaagaaacctccaaactgtcttccaaagtggctgtgccattttgcattgccaccagaaatgaatgagagttcccattgccccatttctctgtcggcttttggttttgtcagtgttcttggattttggccattctaataggtgtgtagtggtatctcattgtttaatttgtaattccctggtaacatatgatgtgaaacatattttcatttgcttatttgccatctgtatacttcctttggtgaggtgtctgttaaggatttttgcccatgttttagtttgtttgtttttgttactgagttttaagagttctttgtgtatttcggataagaattctctaccagatatgtctttcgtaaatattttctttgagcctgtggcttttcttttcgttcttttggcagcatctttcacagagcagaaccttttaacttagtactattcaacttattaattctttctttcatggatcatccctttggtggtgtatctaaaaaactatcaacaaactcaaagtcacctctgttttctccactgctatctgctaggagttttatagttttacattttactctagagtctgtgattgattcattattaattaactttatgaattatatgaacaccacaattactttcaagcagttacacaaatttctaaattcagtggaaatgtatttatttttggtatgtttatttttcatttttattttattttttataatttcaacttttggattcaagagtaaatgtgcaggtttgttacgtgtgtatattgtgtgacactgaggtttggtgctgagcatagtatccaatagctactattttggaccttttcccctcactccctccccactctagtagtccgcagtgtttcttgttcccatctttatatccatgtgtatccaagaaaacatggttttcaaccataatgctgtgttccacaaaaatatatgttcatgttattttattttatttatttatttttgagacagagtcttactctgtcacccaggctggagtgcaatggtgtgatctcggctcactgcaacctctgcctcccgggttcaagggattttcctgcctcagcctccagagtagctgggattataggtgcctgccaccatgcccagataattatgtttgtatttttagtagagacagggtttcaccatgttggccaggctggtctcgaactcccgacctcaggtgatccacccgcgttggccccccaaagtgctgggattacaggtgtgagccactgcacccagcccatgttatcatttgtacagatatattcaatgttgaaattttaaagtgaatttgtgataaaattcacaataatgtcagatatttcaccatcaaaagtataaacttccaatgaagttgatccagtgaataacatgaaagtaaataaattggaattaaataattgtaattaaaacaaaagaagggtgtaaggtttatgcctagataaacttttttgcatgtagatgttgtgttgttcaggaccatttgtttaaagactttttctccactgtattgccttggttcctttgccaaaaatcaattgattatatttatgtggatctgtttctgagctttctattctgttccattgatttacctgtctgttcttttgccaatattactctgtcttgattactgcagttttatatcaagccttgaagtcagatatcgtcaggtctcccacttaggaaactctttaaaataaatttttaagaaaacctttattcaggccaggcacggtggctcacacctgtaatccccccgccccaccccagcactgagctgggcggatgatgaggtcaggagtttgagaccagcctggccaacatggtgaaaccctgtctctactaaaaatacaaaaattagctgggcgtggtggtgcacgcctgtaatcccggctactcgggaggctgaagcaggagagttgcttgaacccgggaggcagaggttgcagtgagctgagatcatgccactgcactccagcctgggcgacagagtgagactctgtctcaaagagaaacaaaaacaaaaagctttacatttgtagctatttctttaaattagatagtcttttcagatacataaaaatatgtggattattgtataagcatttacataatttaatgtgcttagtaaatagtgttgtctagatgattactttttctctgcaactatttctgatattgccatattatatgaaagagtttccctctgtcgcccaggctggagtacagtggcgcaatgatagttcgttgcagcctactcagactactgtgctcaagcagtccttctgcctcagattcctgagtagctgggactacaggctcctgtcaccacgcctgactaattttttaaaattgtttgtttagagatggaggtctctcgattttgcctaggctgatctcaaatccctggactgaagcagtcttcctgcccaggccttctgagtagctcggattacaggcctatctcttaactatttgcttttaaaggaatgtattagatctgcgctgtacaatcacagttaacactggtcacatgtaacctttaaattttaaattatttaaaataaataaaattagattaaattaaatattcttttattttcaagtcatgctgaccacctttcaagtgctgaatacccacatgtggttattggctatcatattggatgacacagatacagatcatttccatccctgcacaaatttatactcaacagtggtgcagactgtccatgtatctgttatttgccctcccatctgtactccagtattttacctggaaatatttttttaaatgcctgtggatgtaaatgaagtcttaaaaaatagtctcatgtagaataaccttctgcctcaaattcaagagaaatctttgttataatatgattgttaagtcacaggtgtgttgttcttactatattttaattgcgttatagttatttgaatagttatgttttaggacatacacattgttatagtcaacacttcttgatgattatagtaatgtagttctactctgtcatagtttaaaatttatgtctccataggaatattattagctaaactcaatagtatgaaattctggctattgttaactgaaataattttgcatttgtggttcaaaatgtaactcttaagggaaataaaggaattcagaaagttttttgaaactcaatcttgtcttccttggaaataggagtactttgattatttttgaaagaaaaattagcctacagcctggtatttaaatatatatgtacatatattatatatttctgctaaattatttatggtagtttattttttccatcttatatacatactggattctcaatttgatttttaataccgcctatatacttattagtaatttcaatggtgtatctttaaaagataaatttcattttagttatgtgacactttatctttcattgttatgaattgcctttttactttttgcagtcttgcgttgaaatgtatcagaaactataatgtaaaaaaaagctgagtagaaatcttataattaaaagttgtagcaagtcatgaaaatggctcatgcttttattgccattttgatgtttttgatggcaaaagtgttgagaaaaagtctttagattcacgtgataagctgacagagtgaaacatcttaaggcttgaaagggcaagtagaagttataattattgtgtagattcacagtccttgtattgaattactcatctttgctctcatgctgcaggccatagagcgagaaaaagctgagaagttcagaaaactgcaagatgccagcagatcagctcaggccctggtggaacagatggtgaatggtaattacacgagttgatttagataatcttcttagggatttgataaacacataggttcatatttatcagctgaattatatcagacaagcacttgttaaatacaaatttaaattaaaaggtgtttgtatgttttttattattctttttttaatgctaaggaaattattaggagaaattcaactttgagttcattggaagaaaatgggatgtggtagaatattttatcagtctgtagcagagaaataaattttaatgcaaatctgctagaatttatccaaataatttaagaaaataaggttaacagaaatttgaaaacattaacagtcatgttatatgtgtaaaactgatcatcatctgattttaaatcatttttgcaatatgtttttccaaacactaaaattatatggaatgttttaccgtcattcctgttttgtaataatatatatgacattttctgtgttactttttatcacttcctctcatttaaaaaagaagtctcttcgggataacctttacttttaagtaacttttttagagtgagataaaagcacaaagctagccaagtttttgtctttctttttcaagaataaattaaaattaatcttttctaatactcagtgcctcaaaagttatgtgtaccaaatgtgtcattgacatgatatgtaaacaaccttctttcaaattatcattgctatactactatatttccagataaaattttacgaaaatcagggataatgctatttccaaataagattatttttcattttgtagaagacgtttacaagaacatcataaataaatacaacaaatgtttttgttgtgcatgtcagcttttttcagaatctgcctgcattttggggcataaattctgtgtataagttattttttgccttaattgcaaatttggcattcaaaagttcagtggtcttcctagaaaatcaattcattttcttcttctaatgagtcccatgactgactgtatttggttaaaaatgaaaacaaacaaatataacaggtgagacttgagtgaacaagtttaagaacaggtaatgaaaataccagtagatttttatttagatgtatgttgcttggtaattttaactgatcaacttaacagcatattcatgttaaataaaattatgtgatctaaaaatattctcctagttgttatgtaagttccccctagaaactgtattatcactttttcattttaataagctgatgcaagagctatactttaaatggtctcatgtcatagttatatatcaagcttacctacactgaattaatcagaaataatttaaacatttagaaattacgggaatgatttttaatttttggtaagtaaaactacatgcaggatttaaatgatcgtgtgactagtgagaatattaattttcttgattatttccctcatagttctaatttttggaggcatgtagaaaagtcaggacacatagtaggtgcttagtaaatattaattgaccagattctgtttagaaaagcaaaattaaggcagtcgttgaggtaataacgttggtaattttggtgtgaaaataataatccatctgaaggaaaatgctaactttggcagataccagggaacactggggggtaggggtgtgatttgagacattcctgtttggttgactgtgttaatcaaattttatgctacccttttgttctaccagtaaagatatggtcgaactgatacgtcattaggctcaagtttgggccataactaggatgactacttaaaatgaccatagctctgtttccccattaaataaaataatttatgaaattacttaaaggctcaaatattctaacttatctatttgttccgtttttgtcgttcaaggaacaaattgcataatatttattttctgtgattgtgcaaattgtgagataagctagacacatattaagtgcctgaagtaccccttcaggtgtatttcagagggactgctaccctaaatcataatagctcctttagtatagagcccaaaagtacagttgagtggtgtagctcatgaagctgaaagacaaatgaagctttctgtaaactaggagtccagcaattattgcattaaagctcttaaatttataagtccagaatcttccttcccaagcttaggctatggagatataataaatctcacaaccacgtaagacacatacattcttgccctttttgtatagaaaggaaaatgagagctgaatcagtgtgcttcatttaggacctcatgtaaatggctgttcctcttaaccacgtatagtttcctcagaagttaagataaagatgaaccactcttgtataaaccactcatattattatgccactaataaaaatatgtgcgtatatatttataaatttgatgtgtgcttaccacagtgaaaatatttaacatatattcatagtgtaaaaatatgtagaatagcataagtatagctattatagattttaaaaaattctgtgaactatattttatatgtatctatactggtatatgcatagcaaactgaattttctacttaaaataatttgccctaagattaaactactttttaaaaatttagaataattttgtaattcatcagtttgcttttagaatgaaattccaagatggaaaaaataatttctcataacttaaattttacttcagttttgacctgaaatggtacatcagacatatttccaaatgatttctgtccgtttctaaatgtctatgaagcattgaagattcaacatcacttaagtaatgcagaaaacaaaatctgtttgtcctgaaggcaatttgttgaaggaatttaagacatatgctgagaagacaggatagggtgttaaggttgttgaaagtacaaaatttaccatggttacaatgtagaagggaacctcatttgatggtgcaaagtattgttaaaaatcagttgtacgttctagaaacagtatgtctagtaacatatgtacagtttttcagtgtcacatacaagttttatgatcaattggaagatactttttattttcactgtattttatcaaatgtgaagagttgtatgcagaattttaaaacagttaatattaaccatatcattaattttacagcaataatttgtatattaagagtttattgaccgtaagagattcttactaatttatttggaatttttaaccaaagaaatgagttggccaaattccttgcctgctttaaaactatacatggacgttttccttatggatgttccagttcttttggtcagagtagaagtgatctttcacgatcatagactaaaaagagaagctactaaaaggagagtgttaactaaaaaaaaaaatcacgtttctggcattttggcatgaaattttggtataatttttaactgatttatctctatcttagctgtattttttgtttgaactaacattaaaattaatttactgttcttatgtcagcattaattggttggataaatgtgacagaatattggatggtgcaaagtacctctttttactagagacatttttggatagctgtaattttcatgcagcttaccgtcaatatgtaagctttggatcataaccctggtctcaggaaactgttaacttaatgagggcaagtgagaggctagaccaggtatctagtgatgtatttatatattcatgtagctgtgcatattgaaaagggagtttccaaattctttattttactttttaagaaagatgtgatataactttaaggtttatttttacatttcttaatttaaatacaaaatgttataaataatttagaaatttagaaaaatttagccattaaatatagtaagtaatctttctaatgctttaataatattgctaactaataatggttttctaagattttaatttgaacagtctttaaactgatgcctttcatgaccaaggcctttcagtgtattattgagattgtggagttttaggacaacctagggctaaaataatatacatatgattatacctaaacatatgtctgtttttatctatttaggattagacgtaatcctttttgtaaaacagtgttctcgcatgagtacatacagtctcatcaatcaggcataacacaaaaaagcctagtttagataaactggttttccatattaatactgaaattaccaaaagatgaccatatcaaaacatttatttgaaaacatatgtaggcgtagctcaggttctcgttctttagtctctaagatcctttcaccataatttctagaggagatactataattatgtaatagggttagttaaattgtgattcattttcaatttctatttgtagttttctgtgtgttaattaagagtctaaggacagtcacatcaaggacatgtttaaataaaagtagtaattattagtatattagactaaagaacatctcaaaactatcattccctgagtgctagattatagtgtttaaggtgatacctgataataagtatgctaactgttgtaattaaatggcacagaatgataacactgacgagagctcttcttatccataacattaaccaagtaactatctttttttcttgtattttggttcatagctcattagataatttcacatgaattatgttatttgaggtgggcaaccagattttgtcagatgggtgagggtagggattatggtcagtctggctcatctcaaagctaaaactctcatgatcactggaaaaactttcagtagcagcaagtcttctaatcatatattttaatggcaagacatattgcaaatagtctgtatacaaatgtggcatggagactgtaccacttgtagtagcccagccccttcatcatgaatgagtagccttccacagttgcatatatttcctcttctcttattccttcctcagtactgggcagtttgatttatatttcttctttctccacatgacacttagtataatgctctacacagagttcacattcaataaatgtttttaattgacaggcacatttttcttcgtttaagtctaatctccaaaaggaagagcctctgtgggtgtgtgtgagcacggcgtgcatgcacgggtgaactcgcatgcgcagacatgtgcgtgtgtgtgtccatgtgtgtgaaagaaagagactgttgttgtcactgttgttgtgggaaatgagtggccaaaacaaatatgagtaaaaatctgactttttttaattttatgatgtttgaaaataaaaacgcaaaagggctatattagtaaaatttatattgccctcactaggggtattacttttatatatactattaatttttaaaagctattactttaagtcagtgtggtcacagaaacctctaaaatttagcctcagaacttgtcttcacaggttttgaatatctctatattacattttagactattacattgaatgctaaatggacttgtaataaccctcacttaaagttcagcaaaaataggagactgtttattagcagctttattttaagtttctattccaaatattcttttaattcaagagctctggaaacacttgttttgtgttattctaccctggcttcatggctaatgatgaatatacttgatgaggaatacttcactttaagtggcagttctgaagtacttgcatggaaggtggtgcacatttaacattattctaacagtctgttatgcactgtacacaagtaataaaattaatggatacacttcaagtaatgatccatttcctctgggtgcaatatatttattcacagactatttcaggggttgtttagaatatgagatgtgaatggattatgatccattatccctgagattctaatgtgctacaacaaaatggtttccataagtattgctcataatgcctggtgtgttagtatttgtattcttaaatagctaacacaaaattagaaaacagatgctcagatgattgatacttaaaacttttcagatatttacacttacaaactcttagaaaagttaaaattttccattgagtcaaggagcataattctatggaatacatataaaacaattatatataataataaaatccatatgcaaatatttacttggataacgctttgaaccctttttcattctagaaaggttttaatggactttcttagaaaatcaacagtagttctggcatttagatggtcaattaattcataaagttgaagtaatagcatttctcattttaattgaagagaggtacattaagtaatgtgacagtgtcggttattaacgtgacagtgtcagtaagtaacgtgaccatcctctccatcccctgcccaagtattttaaagcaaatttgatacaagagagattgtgtgcttgtttgtgtatggcttttggcttcagtgtacattggtctcataatttttatattcatatagagtacactattgatttggtattgaatgagttcatgagtacagtgtagttatactctttctactccaagctgagaattctattagatactgccagtggagacatttcctataggagtttatagtttagaaggacagtttatgcccttgttgagcaggcagcatattcacaatgaattaatacaatgtttgcatacaaatccttcatagcaagacttctgattttctgtgcccaacattatgtcttttctagtaacatctagaaatttccacgttttttttgaaatgttttcgtttctttataacttcaatctcacatgattataaatgtggcagaatattccaggattcccaaataaactctttttatttttattttagttggtgacaggctcttgctctgttgcccaggctagaatacagtgatgcaatcatagctcagtgcagcctcgaactcctggtctcaaaggatccctggttattgataaaacttctttaaaaaatgtataaatacaccttctatatcccatattagtcatatattatataaaattaggactaattttaaaatagtattattaactttttatacatgtcctgtttcagtcattaagaagacttcctctccccctaattttcacacaagagagctggtcccttgttttctgaatattctttttcatttcctctatatggcattgtctaatatgtctttgttgcctagtatgtgtcagcatttgttataagtaagttatatatgttaactcagaactttggtaagtatcctatgaggtcgattctatttttaatcctcatttcatggatgagaaaaacaagatccagtgaaattaagtaactgaacccatttcacacatctagtaaggggcatcaaatttgaactccggtctctttaacgccagaattctcaccggtcatttctctgcctttctgcctgcctccccctttttgctattatagatgtcgttcttttacctatcactgcattttcattgcctgcattcagttataaagatcaatatgcaaataaatagagcgtattataaatttcagtgttatgaatttgtacaaagctgacttttcttcaccatttaaatttcttttacagtgatatattgcaacattttttggggggcaaaacatagagttttgtgtaatgatcaacaatgactcattaaaacctgtccctagattttaacggatactgcagagcctattggtacttcactgtagttttatcatttaacaaaattaacatatccatattgaaaatcaacttatagtttcattttttcatttgctacgatttgtatggttgacctttctcagggacacaaagtgatttctctctgtgttcccgtctcatttagacaaatgttgaataagactcaatccagcatcagtctatcggtccctttaatttagcatttcttttttgcctgtttaatacctggttcatgttgacgtttcacccttcatggacttctaactgcttgttcaagttcaacatatgctgaaaatatttctcctaaatatctgatcatttagatccatgccacattttttgttattaacataatttaaaaattctgtccagtatattttctaattatctttttattttccagaaatgttaacgttttatcataatacttttttcaaacggagtgctcatacgattgaagtttcatattcttctcttacactttataccaaatgtggtcattttataacaacagttacttaatcgcatcgcttaacaaatattttggtacaatttttgatcactcctcaaaatctaacgatcaaaaacagcatgtcacaattgcttccttaagcattaggaggatattagaatatgtagctcctgtaggccacggacttcttttatacttagatatatggagccatgtatatattctttttacattctattatttccattgtatctcattaaaaatatatcagggaagaaggaggggaaaatagttgacgataatatttgcaaagtttgtctccttcaccgccatcctgagtagcattatgctttgaaattagtgaagttacagttgtgtttcaaatgaattgagggacatggtttggcagcattaatatcattatgacaaatagaacattagactatcagggcagagggaagtgaaagaggataaaataatatagttgttgaattcacatctatattttttttagtctttaaaaaggataaagtgggaggcatgtgcaagttagcaaaaccacaggccttatgtttctagagacgttcttcagactttttaagaacttagcttccctttaactaaattatattaccagaaaattaagtaaaatgaacatttataaaagtagattatcttaggcaacctactcttctaccaaactactcttcgaacttttaggtattttaacctagagaaagaaccttacagtgagtttatgttcttttgagatctctgtaggtacatgagggaacataaaacatttaaatattcagtatttccaaagtataagaaagttatcagtgctaatgtagctatgtttaaaaatgcatgatatcatatgtaatatattttctcttttatattctgtcattaagaaaactatataagctaataaatctaagaaagtctaaattttgtaaactaactttagagagtttgaatattttaacccatagcacagcgtgatgttgccatgctttcatgctatgtatggaataatatgtacttggactggcgttcgtcatatatgaaatgacatagcatattccatggtacatagtaggtactccagaatggtaatggtgataatgatatgcttgtgtttccatttttcccttgataaagttttctgggtttggtattactacagatgattttaaaactttgagatcaacttctacatttataaatttaaaaatgtttcacattagaaagattatttttcctagtacttgtttttcttcctcgcatccatggacaatatgagacagagtctcgctctgtcacccaggctggagtgcagtggcgcgatctccgctcactgcaagctccgcctcccgggttcacgccattctcctgcctcagcctcccgagtagctggaaccccaggcgcccgccaccacgcccggctaattttttgtatttttagtagagacggggtttcaccgtgttagccaggatggtcttgatctcccgatgccgtgatcccccacctcggcctcccaaagtgttggaattataggcatgagccaccgtgcccagccgacaatctgtttatttctaatcttctgtaaatgaaataaagaataatcttggattttttttcctctttttaaaactatgaaaatactatttaaactaatttccaagcccatttttaaaattaaaaatgtaagttagtttggggaagtatatttgagtaatatgtatgatatgtaaaatgtatctgaaaacatccaaaatgttacttgttcatgcagccttccagctcccatcagagctttgagcacttttgtttttatttaagtttttatttaatattttatttacatatattctaattttctacatcttatgtcttattacttgatggcattgatattcattgttgtgacgcaagtctgataattcacattgaataatctgaaatcatatttacacatttatatcttagaaaataattgatctggtttgaaatcattcatgtggtgaatacttttataattaggatgtgttggctttcagatcatttctttcagtctgtgggttcaggggatatatttaattatttttttctttctagagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggtaagaatctcttctccttccatttggagcataatcaataggtatttcttggcaatttccaagaagacagtaacaaattatttagtaatgaaacgttcaccttctaaggatttagctaagcgcaataaagttcaaaatgtaagcaacagaaatctgtttaaatatgtaagacgtagatacccggattctaaaattgtatttggcgtagttacacagcgctaattgattgtgtcggtttgcgtaagcatgaggcagtttaggagtgtggaaaccacatgtatcctgtaaaaaatggcctctcactttggaactctttctttgtgacgagtgaaacatagtcattttgaaaaagtggaatccatggaaatagttagaaacacgggtcaacaacaagcttggatgcagtataactagatacataaggaaaatatttaaaactgatggacctctcaaattacgataatttgaggaaggtttctttacaaaaagatatttttaaaatgtagctggagtacagaggaaccacaccggatagtgtagtaacccagcatcagagttcttaccccttttagtccagaaaggatcagtgagagagcagttatagaaactcagaaggagacagtcagatcctcatggtaaaagcagcatggccggcttaaggaatcctcatagaaatggagtcagacaaataaacaccccacttcacttttttccctgcctccagaatcttgtcagggctcctcactgactaaacttaatcgtaagacaaaggacaaggaaccgtcatctgtaaatatcagtctcctgggtaacaggagaagagcggacagtggatctggaggggcaaacaagatgtaagtggacaaaagggcctgagaaagagatgaaaggattatgccttcaagtgtaagaaaacaagagctgtataataatgaaaatagcctaaactgttttcattgttactatgagctatgtgcttttcgcggggaatgagaaactgattagaggatggactaaaacgtttccaggatgaacgtttagtgatagatcgagatgattacatttaatacaaaaggcaaggagtggagattcatttgcatactgtaaaaaagaatggcttaaataaaggtagaatagacatggaaaggtgacaaggttgatttagaaaaggtattggacccaaaaagtgatgagaaattcaaagctattttgaagagaaaaacaattgaaggacttaatggttcttcaaatatcggacctgtagcattattaggttttctgttcttgtgttagtttgctgaggaaataaactcagaaagtatacttttggataaagaataccttggataaggcacttgacttgttaggcaaatacacacatctaaggaatttctacattgagatgcattttgtaatttaagaatagaaccaatgccgcttttcctgtgaatcagaggaataatccaaatacattatttcttgccacaaaaatctgatgttaccttatccgattcttgagattcagatatagtagttagtaatagtacctacacagtacattcatgcataaaatatatacattaagtgtctctaatgtgtttaagaatgctactgagtgtattaatcagctgagtctgccacaataaataccacagactcggtggcttaaacaacacaggtttattttctgagagttctagaagtgagagaaagtccaggatcaaggtttggtagggttcagcttcatcttctggtgaaggctgtcttcctggcttgcagataaccaacttctcactctgtcctcacatggctttcctctgtgtgtatacatgcagagagagagaatgagggctatttttctttctctctctctttatctctgcctccttttataaagccaccaatccctaagggattagccccccaccccgccacccttacccaaccctgatgacgtcatataaacatcattacctcttaaaagtcctatcaccaaatagtctcaccaatggttaggacttcaacatgtgaattttggaagacacaattcagcccatagcactaagttttgggaatattagagtgggcattcatggactctgcttttattgtatttacggaaagcagagaagagagatatgaaacaatggaatcaatatttttaaatttcctgctaggaacagtggtttaaactaagatgcaaagctttgggagaatgagtaacagggaaaaacgaacctgatacagccaccaagggcatcttccttgagggaggaacatttgagttgagacttttgtgataagttagaattaggtaagagaacagttaagcaagattccaggcagaaggaacatggcaagagggagcaataaaggccaagcacctgaatgaagaccattgtaaatgctgaacatagaggggcagatgaatgagaggagagacaaacaggaatcagtcaggtatataggagacaaaccaatgacttctgggacctgctagtatcttggtcttgatttgaggaacaaatggagatcaccagaggttttatatattaaatattgtctggaggttgaggaagtcatcctaagggaaaatacttctcttactgcatccaaattccgttgtcacctccttatcaccccttactctttctctcagacccattggtgtctattaatttgaagaatcactttaggtaaaatatttagcaagataagcttaatattattcatacaagggcaaatatatatactgttctgctgagattagtgataggtaaataaattataacatgtttctcagcgttttattttatttggagaagttttataacattagagcgcatatttagctcatattctaatgatcggcagaactggtttttaatattgtgggggttagagagccttatcagaattggaaaaaattcatgaaccctttcctgtgaaaaatacaaaagcttccatgagataagcatataattttaaagaataaacagactcaaaggagataccatactctggaggaccaactaaaccaaatccttttatggaaataatggctaattgttcacatctttttaaacacagaatacttcagttgaaaagtatctcttctatgatttattctcagaacattaaggtctcaactgaacatttgcccaaatgttttattagtttcaaagtcccctttgtttttcagagcacacttggctataatgttggctctttctatagccccctgaacgggaaaaatggcagccctccatctggccaaatataaatcaggttcttaatggttcacagtagatgccaatgctgccatttgtaaatctagcatacaaattatttgtatatatttctgtactataaatacagaatattaccctttacctcttgtcttatttcttatccatggatatataccaactttctagcactggtttgagaggatttatatttgaaagagaaatataggtcaccttccattttgctaaacgtctttaatcttcacccaccaaaacgattgaatcgtcagagattattttacctgaatcagctcataccattataaccacataaacacattcctctgaaagctgtatttatgtttttttaatgagaataagtggcattgtacattagtcttgcaaccatgacagaatttatgtgataaatttctcagcctctcctaatacaaaagttactctctcccaaagagtatgaatgcctccataaatattaactttttttttgccttttcactttgattttcaggaagctcagatttcaattcgttcagaattggtataattctttccattttctctttcttctaatgggctcatgttccaatttttaaatttcaattttcctgttgttacatattaaatagtaactaaccctcaagtatttttttctaaagacagcatatatatgaattgtaagtaagcagccatgataataacacttttaaaaagggcagtgaaaactttgagttcaaattatatatgtattaaatacgaaacaattccaacttcactggaaacaagaacatgaaaacatttatgtagagaatagcatgcccttcgcccactttttgatggggttgtttgtttttttcttgtaaatttttttgagttcgttgtagattctggatattagccctttgtcagatgagtaggttgcaaaaattttctcccattttgtaggttgcctgttcactctgatggtagtttcttttgctgtgcagaagctctttagtttaattagatcccatttgtcaatttgtcttttgttgccattgcttttggtgttttggacatgaagtccttgcccatgcctatgccctgaatggtattgcctaggttttcttctagggtttttatggttttaggtctaacgtttaaatctttaatccatcttgaattgatttttgtataagttgtaaggaagggatccagtttcagctttctacatatggctagccagttttcccagcaccatttattaaatagggaatcctttccccattgcttgtttttgtcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgtcctgttggcttaggattgacttggcgatgcgggctcttttttggttccatatgaactttaaagtagttttttccaattctgtgaagaaagtcattgtccaaaagaaatacagtgctagccacaaattcaagccacatatgtaatttaaaatggtctagaaactatattaggaaaggaaaaagaaacggtaattgaatttcaatagtacattttatttaacctgattcatcaaaaatattatttgaaagtgtaatcagtatttaaaaactttgagattatgttcttagcttttcttaatcttcagaattaaacatattttggtaatttcatgcatctaaatttggaccagccacatttcaggtgcccagttgccacatgagctagtgacagtacagcagtgttcatgtgattttatcatacaaaccagggtactactgagagtgaaacagggtgctactaataattatgccaggacaacaagaggaaacctggacagccaccgtaatttaaaaagtggcaattggctgggcgcggtggctcacacctgtaatcccagcactttgggaggccaaggtgggtggatcatgaggtcagcagtttgagaccagcctggccaacagtgaaactccatctctactaaaaataaaaaaaatttgctggacacggtagcgggcacctgtaatcccagctactcaggaggctgaggcagaagaatcgcttgaacctggaatgtgaaggttgcatttggccaagatcgcgtcattgcactccagcctgggcaacaagagcgagactctgtcccaaaaaaaaaaaaaaaaaaaaaaaaaagcagtggttgcctgtttggtcaggagaagtaatgagaccatacaaaacatagaagattatagatatatttttatatttgggtgtgtacatacatatgtataagtattatatagattttatatgtgtgtatataatctatataattgtatcaaaatatatttataattatagtatacacatatacatatatgtaggtatatatgtaatttatattttgcagaaatgaaagagaaaatattgttcattgagtgagcttaaaatttgaagcaagcgcacatcattttgatataagaggggtgcagccaaacacctatatttgatttatggaaaggatttaaggtcatgcatagtatttttccactgtacgcattcatacccattaatgctctaaattatgtcatcttgaaatttaaatatcattatataggatgatacatattgaacaaagagccaaggtatccttaaatgtatggctggtgatagaggcttgtctatactgtcatggatgtttcttatcagatatttgtgaagggtattaagctaaacttgccttactgctttttaataccttcttttgcaaaatgtaatgtatgcaaagtaaacgtgttacttactttccatactctatggcacaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaagtaagtaaaaagcctaaaatggctaacttgacattttccaaaatggttatttgtggggaaatccagaaggtactaacatgaaacaataatttctgtaaatggaaccattctccctacaacctgtattaacaaggaacgaaatactggtgtaacagataagctgtctgtagatttttttgtcctcataataattttgtgactttgagaaacaaaacatgttttgtatgggaatagcttctccttgggggattgtagatttcaaaatcagatgttttgaatatagaagaaaataaaagagcagttgaggtcatatgaatacacttcaattaagtctggctcgctgtatatacaaggatatttgctaggcatcttctaatatttctgtcaatttatctgaagagtattatagctttagcatacatgtggcaactgaaactcagcaaaggacaaattattctttgggctacattttactactggatcactataattacataaatcctattttttcctttgatgataaaagataaaagtggagcaattatgcaaattcatgccatgcgactagcaaatttttcaagatgtttcttttgtctcttcctgaattgctttaataagatgatgttaatacatagtatctgctccaaaatatctctactcatcaacttagttttaagacaaaaattcttttcagagacagatgaatgaccacctttaagaaatagtaaatggggttttgattcactatatacatgcatatatgtgttcatgtgcacacaaaaggaattattgagtaaaatcgggtttgaaggcattaagataaaagtatttttctgaaaaaatctctgtcccaaatttgtcatgagaagcacaggaacatgtgtttgtttactactaaaacttaaattagttggaaaatatattatcctattgcttttctttgtaaatatttaaagaattcaccatataatatcatttccagaattaatgtagtgatacacaacgcttttctcatttcccagcttttcattttttacaaaaatgaaatgagctaaataaagcaaaggataaatactttttttttttttttttttttttgtacttcagagtcgtttttgctaaggggtttattttcctgtacaggtagtaaaactttataaatagtatcagctccctctagtggatttcagtatacttgttactgtgcctctgcaaaatcaatttgggaaaatattttaaatgtcctagattttcaaatattgacatatttaacaataatgtattttcacttgtcattacatacataactcccccttaaagttaaatacatttagtggctatgcagcaattgttgtgcaaaggagccatttcactggaaatttactttaatctgtatatacctcttaatcatattaaagttcaactttttatcatttactttaaagatgttcagaatagcaatgtttgataactgagatttgtctatgatgttacaatataaatacgtaataatatatagtctctattcatacagctctccatccatccatccatccctatcatctttcttctcttttttaaatttcatacctacaaacgatgattgtttataaaacttcctaactttttcactgctattatatgtaaacaaattgtccccacttccactgtagctacacatctttaattttactattcacccttttggaatgcttgtctagattaataaataaccctttaattaaatatggtgtatatatatatatatatatggaatgaaaaatgtagcatatgaaattacatagcagttgattttgttaatttgaaattaattcaaataattgcacatgtgtatgcattatatccgaactggcaccagggagtaaatctcatttcttgtattcctccacagtactttggacgtattaagtatgcaggaaataagagctaacagaagtgcctaggcatccatactgacttttatttcctctttacttttttaaacttgctttttcacacaaaaacctggcttttaaaatatactatcagtgttggaaaatggcataaggaattggtagttgttacctgacataagtgatagaagaaaataatataaaaagataaaattctattttcaaagcactttttactctatgcataactaatttatacatcattttacctaaccctcagagagaaacacattgagtatttgttattacaactatatcacaagtaagctaatggggtttgaataactaaaagcatggatatgggatgctgtaagaactagatcgtatacacgaatgtccataacaacattattcataatagccaaaacgtagaagaaacccacatgtccatccagtgatgactatatgaagaaaatgggcacatccatacaaggcagtgttactgagcaataaaaagggagaaagtactgatacatgctacagcatggagtacccttgaagacattatgctgagtgaaagaagccagtcacaaaagatcatatgttatatgagtctcttgatataaaatggccacaataggcaaatctgtacaggcagaaataagattagtggttgcctaggtctgggaggatgagggggtggaattgtttcccatgacagttgataaaatacttttctagagactgaaaaccagtaaactcatgttatatgctagatgaatatagaaacacagcatctagtctgttgtagataattgtttcaacaaagaaaaaaatgaaaccttatttcttaatgtaaagaaggaaaaagattggtcatataatttgagtttatttcattaacaatttggaaatcatgttaaaataattattagggattttattggtttggtttagttttgcaaaaatggagaaagtgacattattagttatgacaaagccagtgttttgactgttctaaagtttcaaaatgattctcttctgttctacaccattagattgctttcagaacagagtcttgctcactttttcactaataaattcaagaaatatttttgaacacctggtatatgccgtaaaagtgctgggcactaggtaatatacatggtggagaaaatcaagagcaatatgtcttcatggagcttattgaaagaaagataataaaattgaatatctgaatattattgcagattataattactttggcgtctgaaaccgtgattctggggagatgatgttagaaccaaacctggagaatgtgcaggtgccagctatatgataagttggagaaaggacattaggagaaatgaaaagaaacacaaattgccaaaggtgaagaatgagggcttggcatgtccagaagacataagggaggccagaaaggctggaatgtaacaaatcaatgaaagattaggacaagatgagggtagaattgctcttatagaacttctataacaggtttggattttaagagcagtagacatttccgaaagaatttcaattgaggaaattaagtacccttagttgtattttttcaaaactcaccctctagctggtatgtgaagaagaaatgcaatacaagtctgaggagaagcaggaagacttgtggaaagaatagccacacagaggagagtccattgaaccttaaactacagttgtgataagataaagaaaaatcatttcaacccttgaagaggtgatgatctggggaggtgtagcacagaagatattcttgccagaattgaaagaaaataacttttacctcttacagagacagtagaagaaaattttaagggtagccagcaaggatgctctccatggccacaatttcaagctctatggttagtctctacccctccctgttaggatgctgagactgggaattaaaacaaagtttgatgtgaggtaactcttctagctgcagttcaggaaattgacctaatttactttattaaaattttaaattttttattttaaaattttatttttaatacatctaggcaaaggaatgttttgttccagtagacacataatctgttgcattgctccttcactccagaaactaggtaaactgtttgtaaatgttccttttaaaaattgtgttatttttatcaataccatcaagagcaagcatagcagacatgtttatttaagcaagctatgtgcttattgtgagataaaagaattgttccctgacctcaagaatcatgggaaaactcgctaaatgccaagttaaagctatacatatatatatacacacgctgtgtgtacatatacgtatatgtacacaagttgtgtgtgcatatacgtatgtacatatatacacatactgtgtatgtacacacacagacacatactgtgtaaatactcacgtaggcaaatattgtgtatatacacacgtagacacatactgtgtatatacacacgtagacacattctgtgtatataaacacgtagacacatactgtgtatgtacacacgtagacacatactgtgtatgtacacacatagacacatactgtgtatatacacatgtagacatatacacacacacacacacacacacacacatttataaaatttatgtgacaggaacctcatactattttccaaaatggctgtactaatttacattcccaccaacaatgtgtaagtgtacttttctccacagcctctccaacatttatctttcatcattttgaaagtagccgttctaattttaacatgtgtaaggtgacacatcattgtggttttcacatttttctgatgtttagagatgttgagcattttttcacatatctgttggccattggtgcctcttattgcgagaaatgtctgttcatatcccttgcccatttttaaatcaggttatttgttttcttgctgttgagttttttgaggtttctatatattttggatattaactccttaccagatatttggtttgcaaatattttctcttgatctgtgagctgcctcttcactctgttaatagtttcctttcctgtgcaggagctttttagtttgatgcaatctaatttgtctatttttgcttttgttgcccatgccatatccatttgagcattattcataacagccaagatacggaaacaacctaaatgtctattacaggacgaatggataaagaaaatgtgatatatatagtgatatatgcatagtggtagatatatatagtgatttatatatactgatatatagagatatatatactgatatatatagtgacatatatatatagtgataaatatattccagtgtctatatatgatatatatatgcaatggaatactatacagtctttaaaaggaaggaatttctgtcatttgccaccatgtagatagaactggcggacattaggctagctgaaatgagccaggcaaagaaagacaaatactgtatgatctcacttatatgagaaatccaaaaaaaagtcaaattatagaaacagaaaatagaaaggtagttaccagagactggggggaagaggaaggttgggaaagggaaggtgttgatcaaatgatagaaagtttcagttagactggaggaataaattgtagcgatctctagtactgcgtggtggacacagttaataaaaatctatgtttcaaaattggtaaaagaatagattttaatatccgcatcacaaaaaaagataagttggtgaggtgattaatatgttaattaacctgagtgaatattttacaatgcatacatagatcaaaacatcacatgataccccataaatacacataattattatttgttagttaaatatgaaatagtttaacatgatattttgaaaataggattgctaagtggatagagctgcttttagaaaaagggaaaattcagcaaaagaaaaaaactcttaaattctaataaatatttctgtagtgtggtagtttatacttacacaaagttggtcagaaaaatgagacttacctggaaaataaatcagttgtccaggaggtgaataatagagcagtatttatgaaaatgaccccaatttcagttggttcattggagttttatgacttataaaacaaattctatggtgatcttagataaaattcctataaacccatctatttcactcatgtcagaccacaccaagtgccctttgtgagaatggagcctgagcagcagcgactttcagcagagcaagttgcataagcaaaaaggcgtgaagtaattaaaaggcatattttgactggaggatagaatattgattttgataggaaattgggctaaaatgttgattgaattcccaatcacaaagatccttgtatttcaaactaaggaaacaacttatatattgacattagaaattcaagttatactcagacttccttgcacttgtaattatctgaaggaccattcctagtatgttaatcatcatatatcatgcatgggtcctgttgtatttcttgacacctttgtcagtgttcacattttagagaaatgcttacttttgtcatggtctatgttatttaataaagtttggagcctttgctgattgcattatctccttgactttagattgatcatggggaatgaggaaaaaggtgggatctggttggcatggaattaaaggctcaagttgagcattttgccgaagtaggtatatgtcattagttcagcttcttcacacatgtgcagtgcatttttttccccacaggtaataatggggaattcaaattggactcgatttcatattcacaacaggacttctaatgtttttaaatgctgtcaatattaagactactaacatatcatctctttctccccctaaatggattacatgggtgccttttccagcttctatctaagcactatccaacagaaaaataatgtgagccatatatttaattttaaatgttctagaaaccacattaacagatcaacaggtaaaagtcatttgaaaatattgtttcatcttagaattaaaattttaaaatgtggaaatagctttacattctttttgtatgaactgtccaatatctggtgtgtctttatatatacaaaacatctcaactcaaactggccacgtttcaagtgcttaacggacgggtagccagttgctaccttattggttggcacagttacgtcttccttctctctattgtacattctctgatgcttaagtgcctattttctgagtagttctatttttcaagaggagagattttttttttcagtaaagtgttatatataaccgattgctctggtatctctttatctcgatagttatgtctctcagaattttcaatatacttctctgtttactttgctttccagttaaagtggtttgcccttgacatagactcatgtgtattagaaaatgtagcatctaatttcatacttagctcttttgttatcacaaaagaatcttgctttgcctctcttggtctgtcctttgctctccttttttctctcttcttttccctttagcccctccctcttttaagagttaaagacaagcagtttttaaacaaaaggtgcagaaaacttcttttttgtattcctttactataattttagatgtcagtttgcctatactttatcacttccatccctcacatggctatattaaatgtctagatattaatggaatttttttttttacttttcaagataaacagtagtgcaggataggagcccttaatttttattttcccaataatttacagcacgtgcttccaagcttgcaatcacttatattgattttcattttgttgaatatatttcactaataaaaccaaaaagatatctgcatttttaaagtggtcctttagcagccgaatagtagaaactgtcataggaatactttctttagagaaaaaagttacatatttataagcaatatattggctaaacgttaaatcttcaggccatatttttcctgagtctgtgctgagtctaatgatgtcagtagaactctcgaggtcttttaagatggtaggttattagattggatatgtttattgtcttattgctgtcagtaaagataaacttatctgttggattattaatctctatttctacataaaaggaaaaaaagtgagtttccgtagatggagctggtctatttctgctcctatgttgggatcacaagggcagcatctacagatatctcaccagctagtaggtggggcagctcatactgtgtttgcccttgggtacattagcttctgtataagactttttctttcttcttatctgaaacagatttagaattcttcactggcattccctggcctgcatggtttaaatgagatactctataccgttgcaaatttgtcaagcatttcctgaaccttgatagcaattactgctgtcattacatagtgtcattacattccacataagaaaatcagaaaaagaaattgtgatatttatgttagtaggtgtgtatttttttttccagcttgcctcacaaactatattagatggacaagttcccaaaccaatctttggaagtttatttcttaaagctacaaaagaatttccaagagattagattttttgaaatgaccagtttcaaatgaatttaatacaaaactaggatgagggttggaatgcaaggaggaattaaaatatgcatgttttaattatagtttaccaatatgaagtgattcctgtgagattcagttgttggacagatcagaagttatacagaaaaagatcaataattcagagactgaagtgtttcagttttcattaaacagaaagaccagaaagaagttaaagaggagacatgttcaagttcaattaaaccaaattttatgaagcttatgattcatccaacataccgccatgtgtctgcccatagtcccctctccttctagatcatttgctgaaatgacatctcagacacaatcatttgcttcattgtaactaaatacctctttacttcactgctatttataaggtcccttttggattttgtttattaataatcatctagaattcaaataaatgcatatgccactcttgccactcctcttcagcatagtactagaagtcctagccagagcagtcagacaagagaaagaaataaagggcatccaaatcggtaaagaggaagtcaaactgtcagtgtttgccgactatatgatcatttaccttcaaaaccctaaggattcctccagaaagtttctagaactgataaaataattcagcaacatttccagatacaagattaatgtacaaaaatcagtagctcttctgtataccaacaacgaccaagcagagaatcaaattaagaactcaaccccttttacaatagctgcaaaaaataaaataaaataacaacaacaacaacaaaaaacttaggaatatacctaaccaaggagtcgaaagacctctccaaggaaaactaccaaacactgctgaaagaaatcatagatgacacaaacaaatgaaaacacatcccatagtcgtggatgggtacaatcagtattgtgaaaatgaccatactgccaaaggcaatctacaaattcagtgcaatccccatcaaaataacagcatcattcttcacagaattagaaaaaaaattctaaaattaatatggaaccaaaaaggagcctgcacagccaaagcaagactaagcaaaaagaacaaatctggaggcatcacactacctgatttcaaactatactataaggccatagtcaccaaaacagcatggtactggtataaatataggcacatagaccaacagaacagaatagagaacccagaaataaaccaaaatacttacacaaactgatcttcaacaaagcaaacaaaaacatacagtaaagaaaggacacccttttcatcaaatggtgctgggataattggctagccacatgtgggagactgaaattggctcctcatctctcacattatacaaaaaccaactaaagatggtttaaagacttaaacctaagacctgaaactataaaaattctagaagataacattggaaaaaactttctagacattggcttaggcaaggatttcatgaccaggaacccaaaagcaaatgtaataaaaacaaagataaatagctggtacctaatttaaattaaaaagcttttgcacagcaaaaggaacaatcagcacagcaaacaggcaacccatggagtgggataaaatcttcacaatctatacatctgacaaaggactaatatccagaatctacaacaaactcaaatcagtaagaaaaatacaatcccatcaaaaagtgggctaaggacatgaatagacagttctcaaaaggagatatacaaatggtcaacaaacttatgaaaaaatgctaacattatgaatgatcagggaaatgcaaatcaaaaccaccatgtgataccaccttactcttgcaagaatgaccataatcaaaaaaattttaaaaagtacatgtttgcgtggatgtggtgatcaggtaacacttctacactgctgatggggatttaaacaagtacagccactatggaaaagagtgtggagattccttaactaaaagtagaactaccactcgatccagcaatcccattactgggtatctacccagaggaaaaaaagtcattattcaaaaaagatacttgcacatgcatgtttatagcagcacagttcacaccagcacaatcgtggaaccaatccaaatgcccatcactgaatgagtggttaaagaaactgtggtgagtgtgtgtgtgtgtgtgtgtgtgtgtgtatgtatgtatgtatatatgatggaatactactcagtcataaaaatgaatgaattaacagcatttgcagtgacctgaatgagattggagactattattctaagtgaagtaactcaggaatggaaaaccaaacattgtatgttctcactgatatgtgggagataatctatgaggacacacaggcattagaatgatataatggactttgggaacttgtggggaaggttggggggagagagaaaagactacaaatagggtacagtgtatactgcttaggtgatgggtgcaccaaaatctcacaaatcaccactaaagaacttactcatgtaaccaaataccacctttacccccaataacttatggaaaaataaaaaataaatgcatcaggttaatagagaaacatattatttatgtaaattaaaacagattttaagtactacaaatatcttttaataagaaatcagaagtgctcagattaaatataatctcttaacatttttatgagttcccaaataaatgcaatataaacatattgaaaaaaattatccatttctaacatttcagcatccattgccaacacactctctaagattatcgcaaccatctgaatactacattaaatacatgcaaaatactttcctatattcttctcatttagtgtagaaggaattggtatattgaaatgacattcatatcccagcaattaaaataatatgatttagataatgttatttgatgtggtgatataaaccaggactttgcagtgtgatttcatgtatttagaaacattattagccattatctgtttaaatatggcttctgccacattctgggatgcatatatattagaccgttttactgtgttctctatctttttgtgtctccatgcttcattccaggtatttccttctgaatcttaagatttagtaattttctatttacccctgtcaaatttgctgttaaacccatgcacttaattcttatttttcacttactgtatttttaattctagaatttcttttggattatccctaaaatatgttatgtcctttttatggtttacagttctctgcagcgttctcaatcttgtgtctaatctctttcaatatagtccatgtggctgcttaagtcacatttcatatatatacatatacacatacatactttaaaacgtataaacttgtttgtatatacatactgtatatctctatataatactttccctaatataattatacatataaaagtatatacatacacatatgcctctttaatagcctgttttctcaattgcaattgggattaacaatgtatatgtctcacaggtttattataagaattaagaatgataatatttatggggttattactagagttcttgatacatatactaagcatgcgtacatgggtgttctttcagtaaaattagacatgacatgatataatttaaaaatcaaggtcttcggataatgatactattttttttccaaggcaaatgataacactgagagagagtagcctttcagtatcagatacaattggaccctgctcggtttctgcaaataccatctgtatcaccttgggcaatttacttagcttctctgtttttctgtttcctgcccttatctgtttttctgtttcctgaccttataaaacgaattgaacaatatagattttacaggctgatttgtgaatttaatgtaatatgtgtaaggtccctggcatattacacatgtagcaggaatgtatcttcataatcatattaaatatatttttcagattttctaattttgttaatatttgaaactagtaatataattgagtttgctgacaatttaggaaaacatggcaaagtgtgaaacaattaagtgattctcattcttttttcccttttgataaagtttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggtctgtgaatatttgaatgtcaaaacaataaagcacgcttatcaagcattcacattgatataacctttaaataatattagaatttaagtcattctgacaagtatggtagtttgcccattgagcaaatgaaaatgagactttacagtattatttatgcatatactctatctatggatatatatgtatgggcatatatacatgctgtttttgaaaacaattgtatgatctatttatgaagtatatttttaatttagcatgcattttcagatgtattgattttgattattagaaaaaccattgttttattccccacctttgcttctttatttgtaactcctgtcacattctcaaactggtgggtaaaatcagtgtacagtcatcccttcgtatccatggggaagtggttccaggaactcctatgaatatcagaattcacagatgttcaagtcctttatatgaatggtgtaatatttgcatataacttatgaacatgctcccatatactttaactcatctctggattacttataatgcctaatacaatgtaaatattatgaaaatatgtgttatactgtattatttaggaagtagtgacaatgaaaaagtcttacatgtttagtacagatgtagttatttttgtcaaatattatctattagtagttgactgaatccactcattcagaatccacaaatatggagggctggctatatttataaaattggtttaaatttaaacattaattttctgtaatgtaatgagacatttgaattctaatagctacatttttttaacatccttctatcaggaaagatatactaatatgggaaatgaaagaaataatttgtaagagattttataatacttttcctactttattttatttttagacggagtttcattcttgttgcccaggctggagtgcagcagtgctatctcggctcactgcaacctacgcctcccgggttcaagtgattctcctgccttagcctcctgagtagctgggattatagtgcgtgccatcacgcctggctaatttttgtatttttaaagtaaagatggggtttcaccatcttggccatgctggtctcaaactcctgacctcagatgatctgcctgcctcagcctcccaaagtgctgggattacaggtgtgagccactgcgcccagcccttttcctacttattataaaatactacattatatgttcaataactttttatttctgaagacatgaaaacgtattagttatatttagaagctgagataatatgtgcattttaagaaaaatgtttaaaaattcaaatttaaactttatcacatagaattttttttggataattaaatatttttttgaagtaatgtattcaaagaaaaatacatttaaacaactttcattatgtattgtcctatttagatatttattctactacaataccaaatggtagctgtttcaccttttttgtttccttttgttgtggtttttaatgcttggcataatgattccaaagtctatctggaaaaatgtgttgcctaatagaactagtaaacttttaaacataagaataaaaatgtgcaagaataagagtggagaaaacacaagaaaaggcagttagatgagcagaagagactatttccactgaaaaagataggaaagaaaataattgttcataaatattattgggaaatgtattaactaactaaaaaaaaagatatgaacatttcccccaaagttacaccaaaataaaaaccacatacaataaaatgttcaaaaaatgtggggaagcccaaattttggaaaatatttaaaataataatgttataaaaatttaggtggagaagcataaaaatcgatggaaacaatcacaaacattgtaaaaacaccagagacaattttaaagaaatatgataccaaggaatctttttttttctgtgagtaaggaagaaagtcttgagtaaggtatcctccaaaaagagacatatatgaataataaacctatgaataattgtaacttaaattgtaaaggaagaagtaaaaaaattacaagatgagaattttttttgcatactaaattgcatacacacaaaagatataagtaccaatttgcaagtggtgaaataaaaattgtctcttactgctggaaatgtaaattcaatatgaattttactgaggttaactcttcagtgcatcctaataacatacaacattaatataatttccatgaaatctgtatctgatggaaataatcagaatacactcaaagatgtaaatggaactggagatagataggatattgattgattgagggatggatggatggattagataggtaggtagatagagataaacataatttacaggagtggaaaactagaaatgaatgtgtagaactaataatggaaattgttgaactagaaaagccattacaatttttgtttttgaaaaaataattatttgacatgggcaaatgctcacactaaaacacctagctcaaagtgtagttatatgctagatattgtctaaataatcagtcataggggaacaatttgaaaaagtgaaataaacttaaaaaagtaaagtaaaaaaacaaattaagtaccaccaaataggcataggatactatgaaactataaaacttagatatttgacaaattttgggttgatataggtcacattataggggaaagaataactgtttatatgtgcatacatgatcatatatttaatatttagctatacatagaacaaattgaaaatttatataaagtactagtagttctggtttttttttccatttttgtcatgagcctttattattttataaagtaaaagtaacattaaagtaaatattgaacaggggaagtctaaagttatgatcctactgtaagaaattacatgtgttatacagaataagtataaataaattttataaattctccacaaaactatccttgaatcccaccataatactacataacagaataacattttttgaaaatatattaagtacatagattgttcaataagtttttctattccatatatcaatattattagctatagttttatgtagagtttactttcctgaaagctcagtataattaatttcaactccattaactgtatcacaaatgcagttattaatatatatacttaattcagtaaaattagatgcaccaaaactttttggctctgtaagatatagttttgagatatatttgacattgttcagaaaaatacatatggagtgttaaataccactaaataatattcaagttactcttaggataatatgtaaaatttaaattaccactagaagtttataactgatagaagatcatctactttgtttacatgtttgaatcatatagatttcaagtacagttaatttcactaaaactcatcaattattattcatcaattagggtaaatgtatttaaaaaattgttttttaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcaggtaattcaagattttactttctaccctcatttttatttacttgttttttccctaacgatacactgtaaactgtaaaggtacataagcatttgaccttcagcatctttcaaagttagtgagaagatgaaaagacatgagtcttttacaaaggatggcgatttgcttattccttctaggaaaagaataggagttttctcagtgtttttagaatgaattttctattttcaccattaccaataggaattaaacatgtttttagtttaataattttcaaaaccaatcatccatttagtctggttgtcttttaagatacgggtaatcatttagcttatgactagaaaaaagttatgtatatatacattatacagaggtatattgtaatcattttatatatataatgtatagtatgtatatgattatttcctatattacctttcatttctgctgttttgctacttataaaaagtaggagtcaactatgctgtctatatgtgctattatatataaaatatggtgatatgttcataaaattgcattatatattcatcccattatgtataactccatatatgtatatgtgcagtagaaatgtaggtgtattaatgtcctatgatactcctaagaaattagcagaaatttaatggcttcaaacaacacaaatttattacattactgttctggaggtcagaagttcagaattaatctctgtgggctaaaattaaggtgttagcagaactgtgtctgttttggagactttgaaagagaatgtgtgttattggcatttttagcttccatatatatatgtatatatatacacacacatacatataacatgtatatatgtgtgtatatatatatatatatacgtgtataatggaattatatatcatgtacatatatacatatctaatgtaatatatatcacatatgtaacctgttgtatatgtatattaatgttacatatgtaatatatagtaataacttattttatcaccatatcgaatttgtaattatatgcttaaattttaccacatcaccttcttcctgaaaccaaattcccttgacttaatttgtttgaatagtgccaccatactaataaccactcaagctaaagaaaaacagtaaaccaacaattgcattaaggtctaaaagcctaaaatattcaataaggtaagtaatgtgtcccttgagtggtcaattattgtgacaaatgttaatgctgggaaggaaatgtcgaaaacgttatggtatgatggaaaaacattgcaacaatatgctcctggatttaaatcccagtctagctgcttagtttttgtgcttaccttttacaaaccaaagcactaagcaaacctaaaacattttttaatgcatagcatttctttacttataaacatatgtgtacatgcatacctatgtaaatactgcatgaaaatatctattatttgtcaagaccagtggcctaagagggcacaattacatggctcttgttatcaaggagcccacattctagtgaaggaggaaggtaggtgtattcatttcctatggcactcctaacaaattgccggaaatttaataacttcaagcaacacaaatttattagagttctggaagtcaaaagttcaggattagtctcagtgggctaaaattaaggtgtcagcaggactttgtctgttttggaggctttgcgacagagtctgttttattggcatttttagcttctagaagcattccttgtctcatgtccccatcctccatcttcaaagtcagcagtgtaacatcatctagtgtcaatttctctctccctgtctatctccctctccctctctttctacctctccttctcaccttcctttccctatcctgttccctgtgttgacttccttttaattaggacctttgtgattacattatgccctggtggatgatccagtataatctccccatctcagaatccttaatgtaatcacatctgcaaagtcctttctggtaatatactcacaggtttcagagattagggtgaggacatcttgggggtagcattattcagccttgcatggtaaataaattaaacagtatgggaaaggttgtcacagtaggcaggaaggaaatccaacataaactaggaaaaaggattatgaaatattatcggaacataggttgtctctgctatagattaaataggtagaatttagttagctaataccgagaaagaaagagttcttgagaaagcatagcagcattttcagttaaatgatataagttcaacactgggtagacaatatatatggggattaataaaatattatggttggaaaactggattgagagtagacagtgaatgtccttggatgctatgttttacaatctgagttttaatctagtggtgatgggactgataataataacaataaaaacttaataagaaaaaactgctattggttaaagagggaaataatatgattccacttgtgttttcaaaacattcccaagatgagaggaaggaggagaggagattactggcatcactgtagatcagtaattagaatgaggtgagaccgaggcagatatcaaaacgagccagtgcattaatggagtcactaatgagacctgaacagcccaggcgtagtggctcatgcctataatcccagcactctgggcagctgaggcaggtagatcacgaggtcaagagatcaagaccatgctggccaacatggcgaaaccctgtctctactaaaaacacaaaaattagctgggcatggtagtgcacgcctgtaatcccagctacttgggaggctgaggcaggagaatggcgtgaacctgggaggtggaggctgcagtgagccaagattgtgccacttcactccagcctgggcgacagagcaagactccatctcaaaaaaaaaaaaaaaaaaaaacaaaaaacaaacaaaaaaaaaaagacctgaacaaggacagtgaagatgtgaaataagaacaaatgtagacttgaaagataacagcaaggtgatcgtcttgaagttctcttagataaatagtttaaaaattattattaataatcacattaaaggggaaactttctgtggagcacatattttcaatgtaaatttaagtaaaacagaagaaaataacacatgtagacagcatagttgaatcatactttttagaagtggcaaaacagcagaaaaaaaggtaatacgggaaagaatcatgggtgagagatactggctatttataaatgataaaagatgatgatttttacctgatcattacttcgtactggtcagacaaataaaagcaaaagctctgtctttgaagatgacaaaatattagtccaaaagttcccaactggaaggactatttaaactgtcatctgtagaaaataatttgtgaaagttcgggtttagggaggctataaagacaccattacattgagtttattgttcatagtttgttttatgtactgtaaggacacatttttagtattctcatgagttgttttgtaacttaaaatttctctagagggggatatgatttaatgttctcgagagtaacatcataaaaccacatttggtagtaattttgtatttttaacaatagcagacttcacacaccagtgctcatacagtagaccataaaaatgcagtcttagtaaaaatattctttgcctcaagaactacttagagacatcctttaaacatgggaattgtttttgggcctgtgtttagacataacacaatgatgaattgtgttaaaagtaatcagcacaccagtaatgccttataacgggtctcgtttcagaatcacatacaaaccctgaagaaatggatggctgaagttgatgtttttctgaaggaggaatggcctgcccttggggattcagaaattctaaaaaagcagctgaaacagtgcagagtaagatttttatatgatgcctttaatatgaataattttgtatgaatattatttggttagatcagtgttttacagctggggtggattttgctctcctctccccagtggattttttttaatgtttctagacgtttttgattgtcacagctgggttgggggtggtggttagatgctactggtgtctaataggtagaggagagagatgctgctaaatatcgtacagtccatagaacattcctccagaacaaggaactgcacaatctaaaatgtcactagtgccaatgttgagaaaccctgggttgagtaaatgaggaactgacaaaacattgccttgtactcaacctcatttgataacattattttactataaaatgcagtataatttaaaggtaaagaatcctttgagctacttgttatttcttatgataaattactattcatactgtgttgttctcttcatctataatgcactgtactataatataacacagtatgcattttgaaataatattcattataccattgtcatgcagcaggaagaaaacaatcttgctctttaaggaaatttttttacaatacaagctaaaaaagcaaatccacctcacaaataaccttcacacccattacactgtaaacaatttctgcagtatcctgtgtttgaaaatgaaaatactaacaaagataataaagtatgaagcccatcattttcacacatttttctaaccagaaatattaaatttatttccttttgtttctgatataagtagaatacaaataattccccactggattcatgccataataaccattgaacatttttgcaagactgttaggcagtcatctatatcaatatctctgtatctcagattttaaaagacaaaaatccatatgcaatgccatcagtcccaattttacattttctagctatgtttcatatctaatatgtggcagtaatttttttcagctggcttaaattgatttattttcttagcttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtatagacaatctctttcactgtggcttgcctcaacgtacttaactaagatttcctaatgtctcccttcaccgttacttttggttaaggctttgttcctatgtttttgctttaaagcacaattaattctgacaaattaatcttttttctagcatatctaaatattttcatggtatatattttaaatagtacacattcatcttattttgatcctaaaatgactttcttgaacacaactgtcatactaaaaaatgaaatcctattcttagtcattatttccaatccatgttttcttcagaacataaatgtataataataatgggattaagaaaaatttgttacacggagatatttggtacaaaataaaatgcatggctaatatatgtgtatgtagaaataggataaataattataactttcgattaacatttccaagtttggcctcttcgacacatttattatttatttattttattttttgggacagggtctccctctgtcacccaggctggagtgcagtggtgtgaactcggctcactgcagcctcaacctcctgggctcaagcaattctcccatctcagtccccacaagtagctagaagtacaggtgtgtgccaccatgcctggctaattttttgttattttttggtagagacagggtcttgctgtgtttcccaggctggttttgaattcctgggctcaaacaatgctctttccttggcctcccaaaatgctggaattataggtgtgagttaccacacctggctgacatctagttttaaataacaattaagattcagtaaccattaagaatagctgaatttcaaaaaaaaacacacacaaaatgactgtacactcatatttgagtttctcatttttctacagaagaatattttatagatatctctcttatatttaaatattcaattacggatagtaagatatattcaaaaatagtgtatatcaaatacttcttgttcgaaagataaaattttgaactaaagcaatgaatacttttaagttcaccaatacattagtccccgatcatctgcagttttgctttccctggtttcaaatgcttgtggtcaattggaatcctaaaatcggtgagcacagtaaaataagatattttgagagggagaagaagagagataacttgttctattttattagttgttaatctcttactatgcctaatttataaattaaattttataggtatgtatgagtaggaaaaaatctagtgtatatagggttaggtatcatctatggtttcaggcatctattggaggtcttggtatgaacatatcttccaaagatacaagggaactactgtacctttttggaaattaataaggggtttcaatttacgtgttagaggcagttggtctttggttactgctaagtaaactttcaaaatagaaaagaagtaatgtcaaaaggcaaaagctacatttgaaaatgaaaaaaaaaattagaaaagtcaagggaaatcactcagctaatacaatcactgacaagtgttcattggttctgttaattcacagatgagctgtccctgggtcagctagctcacattcttctcctgaagtaagtcagtgctagaagagttgtttaggaaaaaaaaaaaatattacttaaataatagattataccattgatgttttcctggaaggccagtgtgaaaggtatttgttttttgtttgttgaatgttcttaatggatgaataaaaagaacatcaccaatttatgtagagcaaggggaaaacatcagccaaaaaaaaaaagtataaaaccaacaatattactaaaacctcaaggtttttacattttacaggagtacaatttgtaaaggctctctaaaaatgtctttgcttaagaccttatgtctgttatatgtactaagaatttgttgttcaagagatatattttaaacacactcatctgttgcatagcaaaaaagctatagatccaagctatgttctgatctccattttctaatcttagaatattatatgtatctgtgcttttcctacaagtatcactctggccatgttctgactttgtagccaaatgagttaggttgtaaaaggaaggaacaatggcgctcaaggagaagaagaagacgatgcggtaaaaacaaggaagccatatgtgaatattgttaccaattcagcattccagagagaataatggaaatgaagtgtaaatctatgcattacagaaatatctacagacaaaataagtgtgtgatacactcttttgggttaaagataattccttttttgtcaccagatgccaatgtctgcgaaaacataaataatttgaaacaaaattgtccaaatatctgatacatttgaagatgctttcacatcccatgatctaattttgggtatataaaatggttattattttaaattttaaagggtatgtatataagtttaaaaatctagattctagctatttctaaaaaaatgatcagatataagtgagggaataaaatagacattgtagttaccttcacggagataatagtttagtggtgaaaatggaaagtaaataggttaacacattatcacaacaatgtcttgtttgaagtcttgcttacactctgaatgtagcaataagaaccctttaaatgagagtgacaggagcaggaaaactactttctattgggtagtcagtagagtgttttctgaagaggcgaaattaaagctgatacccgagtagtaggaacttgacaatttgttgtgtcaaggaattctgccagaaaatgaagtggagaaaacatctgaggcaagagagggcttagcatgtttgaggagctcaaaggaagccaggagaaaaagagtgggaaaatgagtcagaaaggaatatggaagccacagtgatgatttagtcattatgtcaagtactttggaaagtcatctgacttttaagcataggagtggcatcatttcatttcatttaaaatggttgttttaagtttgctgcatattcctattagaagaagaataaatcaaaagggctgaagtggaagcaggtagggattgcaattgtccaggtagaaaaaaaaaacaggcaggaaaaaggggatatttgtggatattgtagttttctgaggaacctccatgctgttctctacagtgactgtaccatttatattcccactaacagtgtagtgtagttcctttttatctgcatccgtgccaacaattattttttgtctttttggcaatatacatcctagctggggtgaggtgatacctcattgtggttttggtttgcatttatttgatgattaccgatgtggaatttttttttcatatattaattggccatttttttcttcttttggaaataactgttcagattatttgcccatttttgaatcccatcacatccacatatgatatgatgttttatatcataaaatcgttatttttctttttatgatatctgagtttctagcttctgcacagcaaaggaaacagtaaacagaatgaaaagacaatccacagaatgggaaaaaatatttgcaaactactcatccaacagaggattagtatcctcattacatttttgatgaggactttcacacttacatctacccagaagtattattcctatcctaacatgacacattcctttattctttttaacagatcccattagatctggcagtacttgctgaaggagagtgtttgttgatagtctagaggaagaatgagggaagaatcaaagtgttttcagatatatttctgttatgagctacattgtaggtcattgtgattttaaagaaagagtgggtactaagagaagaacaaaatggaatagcttactagagtgactagcggttccatcttagccatatttatttcggagaaaaagacaatcagacatgtatctggaagtcaagtacacttttcaaactgggcatataaacgaggtacataaaaataaagataacatgtatataagatactgtttcttgcctattgagaagatttccccatgctcccatccctaaaatgcttggtcaaattggataattcgtaaactcttagagatggaagagaatctatttttgtttaaaccactttgttgaggtatgactgacataccaaaagctgtacatatttaatttatacaacttgattagtttggggataagcgtatacccatgagacttattaccacattcaagatgataaacttacctatcacctccaaaagtttccttctgccccttaatttatttattttttttgttttgtgataagagctcctaagatctatcctcttggaatatttttaacaatacagtatttttaactataggcccaatgttgtacagtagatctgcagagctaattcatcttgcataactgaagctttgtatcctttgggcatcattttgccattttcccctctctcagcctttggaaaccactattctactctctagttctgtgagtttgactattttagattctagggaatggaaggaaatattcacaaatcatatgtctggcaaatgattaatatccaaaatatataaggaacttctaaaattcaatagcaaaaataaaactgaaaaataacctgattaaaaatgagcacaggacttgaatagtcatttctctaaagaatacgtagaaatgaccaacaggtatatgaaaaggtgcatcactaatcatctgaaaaatgcagttaaaagccacaagaacctcttcatacctgttagggtggctattatcagaacaaaacaaagcaaaagatactaagtgttggcaagaatgtggagaaaagggaattcttttatggtgttggttggaatgtaaattggtgcagccatttgggagaacagtttggaggttcctcaaaaaattacaaatagaattcccatttgattcaccaatcccgcttctggatatatatccaaaggaaataaaatcaggatctcaaggaggtatctgcacccctatgtttacagcagcaatatttacaatagccaagacatggaaacaatctaaatgtatattgtcaaataaataaaacatggtatatgcatataacggaatattatgtagctttaaaaaagaaaattcttccatttgcagcagcatagatgaacttggaggatagtatgctaagtgaaataaaccagacacacgcggtcaaatactggagaatattttttttgtggatggaaaggcacagtgtgtaagaccagaagctctgagatcagatcgcctgggtttaagtctatccacatcataaactgcctgtgtgattctagaaaagttgtttaacctttttgtgcttgagtctcccaatctttaaaatgtgatgatattaatacataattcataagtatataataattaaatgaattcatcttttcaaggtgtatagagcctcatctaacctagattaatcactgtacatgtttgttagatagaaaacaaatagaaacctacatatatagaattataaaacatgtatactttctaagtaaataatatatggttatatattttaattattagtggctttaaatttatagtaaatagttatcaataaatgggatttagaggttacgtggatgtctttctgccagcttgcagatcattgtctttctctgggtcagtatactctttgggtgtagtgatccccagatctctttcgtcagatctctaacagtctgtttttccatctttctgcaaaaaactagcttcttgttttaccgagaaaatataagcaatcagaatagaagttgcagtactcccactgacctgcatataagctcacagactctactttccctttgtttacatagatgaactttctgtgcttttgtctaaggccagcttttccacttacgtacctggatccctttcccttgtctctgcacaaggacattgtaacagctaatgaacagccctctacctcctacatcttctccacgctacatcattcccatcattcccatcagtagagaattattctgtaatatctcctgtcatttaaaagaatcctcaattggacaacaatctctctagcaacctctccattcccgtttccctttacagacattcctttctctccatttcactccttcccttctctcttgatgccaattaagagagctaatcaaactgttatcctcactattctattaaagcagattttgtcagggtcatcagtgaattcgtattactaaatcgctaaattcagttggcttctgtgtcatcattctttcttaattatctcttagttttccctgaccactgtcaatatccttggtggttctattgccctgaccactaaatttgaaagtgttccagggctcagtctgtggactccttttttttttccccctattaccacccactctccgggtcaacttatcaagctccatagttttaaatgtaatctgtaagttgttcctgctgtaagttttttttttttttttttttaacaatctggaccctttctaatgatcctagacctgcatacccatttgcccactcaacacctccacatcaattaataataggcatattaaatctaacatgttaaaacaaaattcctgatgtataccccagtctactaccctagaaatttgcctgttattacaaatggcacctccatctttccacttattcaagccaaatcccacgagattttcttgtctcctatatttctcttacagccgaacatcaaatctatcaccaaatgctgtcgtttttgccttcaaaatttccaggatccaacaatatctcaccatacttgagcacgtgcacacacacacacacatacacacacacacacacacacacacacacacacacacacaaagtatgtatgtgaatgtatagtttttactagaagtcttggctgaattccattagtccctctaatatttttgtagcttcaccaactgccttaaaagattataacagagcagagtttctaagtagaaatttagcagcaggatttcttaatttataaaatagcaaaaatagcagcatgttttcttaagtttattataggttcattgactgcacaaaataacatttataccttttctagtacaattgcaagacatattgttctagatgtgttagggtgaaacatttatttacattgtagtagatcaagtactacatttacctaggtaagtaaagaacctaaaatgaagtattatctatattaggctcaaaatggttgtaaattataaggaaaatcaatgcgatagtgattctacacatatttactattgggcaaagtaccatgaacacttcattttactaaaactgtgcattatatattaatactatgaaaactctgttacttaaaatgtataatgttgtttcaaccagagagaagaataccatcttttgaatagagttactttttaaagtaaaagcactatgtataatgattgtaatactatagagtgccttgtaacaaggtgtatgattttcttttagatgttttaagttttgcatttttctggttaatgagtaatggagtccattgtagaaagttttagttttcaaaaatgcgtgaggctttaaatagcagatgttttctataaccacagacagactcttttgcaacttgcattttacacgtaaaactttatattgagccacttttcatttcagtaaagatgtatttgtgatgcacagtatcccatagtatatatatgtcataatttaatctctcatgaaagcacctttgggtttgttttcaagatgtttggtctttaaagctgaattaaatattgtacatgttagtctctacactttggttggcatgattcactctcaaaaaatggagcagttgactcagattcgtggacattaacatttttatatgttttgccatcttactatctaaaaggttgtattatgttggatatttccctcaacaagtataaaaactttgattttcccacatccctgcccaaaatgggctctttattaattattatttttccctgtcttaacatgtgaaaatgcattaattcacttcgatttgcaatcatttaactataaatggtattagaacatcttttatatacatgtattgccatatattatcttctttgtgaattgccaaactacgttttatgcacttttcgttttttctttttaatttatgagagtttctgtagatacatgattatgaagttcttagaatatttaaaatagtaaaacattatgaaagaacacaaagaataactatttctatgtatgccaataaaattacttttccaactgaaacatattattttaaaaagccttgtttttctccattcacagaaaagcattgtcacacaaacagctgaattatcatcatcgggcaatacgttcattttattaagtatgccaaataaacagacatgtcttattttcacacttatgggaaattgagtgtatctgatccccatgagttattttcttatgcatataagctttttacttctttatcattactatctaagctttctgttatttacatactgatgaaataatataataataatgtttcatcactgtcaataatcgtgttttgtttgtttgttttgtggaaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaaggtaaaaaaaaaaaaagaaaaactaagtaaaacaaaggaaataaatggaaaaagaaagaaatgcaacaatgcttgaagttgtatacagtctgctctttcctggttctaagagaagaggttgatttttaattaataattttaatttagcttcaagtttaatatacattttaacaaccttaaactgtttaattttaatgcattgtggtcaattatgaaaattgaaaatcacaatttgaaacaattttcccttgaaatcatgtagtattaagagagcagaatcaactcatttcattaactgtctgtagctgatgtaaatgtacgttgaaactgtgcaaaagtattcttgaaaagacaaatttataatgtagtcaacaaactgtgttaatttggtagtttgaaggcatttctgagaatttggaaacactaaatatttgaacccgtagcctttaatatggatagaaaggactgagtttacatgtacttttcttgaaacaataggacaaaatataacattgacttattacgaaggaaactggtatgtagtatgtagtatggatttggaggtgaagcctggacttgaacctacatagtggcatttcgtatggccttgggcaacaatataatagtcaatataatcctctgttttatcatgtttatatcatcatacttcctcacttgaatgtatgaactgttgattgtaactaccatgtgagtaaattgcctaactcagagttggtgctcaattagtagctataatcataattattatttttatgtgctagcaagaacttagagaatgacttgaaatattaatactgtagatctttttttggttcaaggattgtgacaaggaaaaatcaatgtggagccagatacttgagtttaaaacttagttcggccccatgccaactgtataaattggggtgagttacatgagcttactgagccaaattccttcgtttgtgaactgggtatcagaatgtctgctttcagaatcattagagggatgaaatatgaaatttctaacacaatgcctagcacagtataaatgaccatgactcattatttattattttaattgtgaaagggccacatggtaaaaaattatataattaaatggtaattcagaaatatctattatagttaatagcagaaagtaactcacatgaaaactcagatgtttaaatatcgaatctgtcatacggctttagtcaaatgttgaaagtaaatatctaatatactccataaatatgtataaatattatgtgtgtataaaactataatgaagaaaaaattagtataatcatttctagagtattaaaaacacagaattattctaatctagcaatagcatatttatcaactaaaacttattgcatacttactgtgtgccaaacaccctctggctactgaatatagagggtggtgagcaagaccactgccttggaatttacattctagtgttctagcgtgtggtgaggagcaggcaataaatggaaaaataaatgaaatcatgataatttgcctagaagtaaacatggattttgaaatcaagaatgaataatgttcaggcaggatttgagggtggtaggatgctattttagaaaaacttgacttatagagcatttatgaagaattgtatgtaatatgagagaactgaatcataaggaaaagccaaccacttaaaaaaatctttatggaaacacattctattcagagagcatagcttctgcaaagaccctgaagctaattgggaagagaaagaaatctgcctgaaggaaggaaaatgggataaaattacctcagataagtcttaggaggtgggcaaatatctgttaacaaacgggttttgttagagtatcacagtttttattctaaatggacaagaaaaaccattggagtatttcaaaagaccaaaataatttaaaatttgactttggggaggtcacccctgaggaaaactttatcagaatgtgagagctagaaggtactttgaaacttgtgtaattcacacttctctctctgcttatcagaaaactgcaattcccagataggtcaaatgatttagccatagtcacagactttatttgtggtagagcccacaggattgaaggtattttattctatttcatctcttttttcctttcctttcctttcctttcctttcctttcctttcctttcctttcctttcctttcctttcctttcctttcctttcctttccctttccctttccctttccctttccctttccctttcctttcccttccctttccctttccctttccctttccctttccctttccctttccctttccctttccctttcactttcactttcactttcactttcactttccctttccttttcctttcctttcttttccattgtgtgtcactcatatggccttttctcttgtatctcaattcctttctcactgcgtctatttatatatggccactacctcagatccgtaagtagatactatagagtcatttgtgttcagctgctctgattatccctgggttcctttggttcagtgcctcttctggccctcttccctctccctatgagcgatttgcctatgtcaccaacaacccagtcagatctctcttattttcctgtgctctagagtaaactgtctcaaatttttaaaatttgaaaaccatccttgaaatgagtgttccaacaaatttgtctacattgattgacatgttttgataattggtctagctacaaaattggtttagtatgggggtgatagtaaaaagaggtaaactctggaagcctctggcaacaaccactggaagagttggcaggaagatttcatttcttgagttttcagcctgctactcaagacagtttctttaaggcaacttcactacctggaggttagcaatagtaccttgtccagacttctacctgtgctcatttgatagctaatttttctttattgtcagaagatactaacagacctattttgacatctctccctgatactcaaagaagaaatagagacccccccttctgtttatgttctttcctgtgttttacctgaaaatggaagtgctgttttaataacttatttttcccctgaaaaggaaagtttttttgacataaaagaacccagggtacagtttgataaacaacctctgactttaaaacttttatggagatcagcaatcactatatggtaaaactttatactaaaaccctttgaaaaacactctggaaagttattaactggttttatttttttttaatttttactctattataactctagtactagtgcttaccagaacttacacataaagtgagaatagtaaatacacaaataaatttgtataatcactacagcagtgattcctgcatctgaatggacatcagaatcacctggaagtcttgtttaatacacagagtgctgggccctgaccccagaatttctgattcagtgagtcttgggtgaggcctgtagtttttcatttttaacaagtttgagtttgataccaaagaacaagttgcagagtgattccaagggtgctcactttaagaagcacgggtgtgaaatcctagcaatgaaagatggcagagcatatcatagttagattcatggaaagaaacaagagccaccgtttttatgaggatttgtatagaaactgtaccagtcatttagctttctaccttttctcctagtagagaaattcatcatcatcttctttcctcatatgtacctggattaataaattttgctgtttgttcttcgaacctttcccaagatctgagcctcttattaaaccaagaatatatgaagtctaaaaaccatggaaagaagtgttcttcattctacatttttatatagttgcttgggttatttataatgagcataaattgtaattttattcattagactgactacagcatgctccttcttcagctcatggaacatttgagacccgcttaacagaaactatgagaaagagaggatataactctgaggatgatttccttaaactctctgaacctcagttttctaatgtccaatatagaggtaacaaaacacatccgagaaggtttgggtaaagatctaatgaggtagcacttatgacatggctggcacagaacacagtagcacatattaaatgatgaatggtaatcaaacttgttgattatactataattactaaagtcaaaatgcaatttgtgtaaaaacaatctctatgctcagtgatgccaaaaagctgatttatttagaatattgaactaaagatttcaatcaattaaaatcggtgaagttaagcattctatagacaaaacaatttgcattttctgacataatgcatacttttaaggaattgtgggactaaatccaaaggagtagggtgattatgctgacacatacaaaggcattttatagctgaccttatccatatcctgccaataagcccttaccttaaccaccgcattgtatgcaggcccaacttctacattatagaacctgagttcctttacttgagggctttctgtggccactgaatcccacttttgcacttgtgtggtaggcttgcaagtactgggaaattaacatttccccaacagcctttaacaattagggaagatgatacagaaataataccccaatttcttcacccctgaatgggataacccgcaggcatatatttctcagggctttctaacaggattaaactctagtcattaacagtgtttgctgggattaataagtatgcccatatggatgtctcttccctttcttgtctcaattccccattcagctaccagaatttcttttacatggcacacataaataaactacttatatttgaaagctaatgtcaggtttgacccctggaggaacacagactaaagatacagtgtgtatgtgtgtgtgtttctaaaatacatgtacgcatttgaagttaaggagtgtaaatgtctcccaaccgaagaccaccaccaactctcttgtagctgaacaagttgggttcattattttttgcaatgagggagaatacacaacatggaggccagggggtgcgtgtggatgaaaaaaaaaaaaaacattgtaggatttgtgcttgtgttaggggatttgagggagggtttaaaagctttactttggattgcttgtcattagtgtgtagggatagctatatgggtatcgtatcttgtccagaaggagagaagaccagaatgaggctaaagttgcaattaataaagaaacggcgttcgttcatattaaccaggataggagagtgttgggcgttttgtggtttgggtaatgttgatgtttttgtctggattcagacatgattatggaatgatcttgtcatggtcttgatccattatggaaacaaagtggccttttccaatgttgaaattctgtgaaacagtttattttccacttgagaagaccaaggcatagctgggtgtcaggccagcttctgatatcagcagctccttttttggtttctctttctctcatgtgttttcaattctcgaacgaaactttcttttatcaaaatatgttcctaaatatagcatcaaggggacctttctatgttaagtatcctttaacttaaataatgatatttgtgatggtttcaatattattcatccaagtaatttataagtgatttcaattctagactgccaaatattttttaacctagttaatattgaaatatttgtttcttgccttttccaaacaattgtatttatatcaatgtgtatatatttgaccacaaatccatacctccatgcagactacttttcagtctattcttgttacagatctgttgtattcttataataaattatttctttaactttccaatttcaactaaacttaaatttatggaagagactggagttcatattagatttatttttgtaattctcattctaactgggatgttgtgagaaagaaattatatgattcatagaaatgcattttggatgtaaagttattttcatgctattaagagagcattctttatttttcagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagtcagttgcttttcttggtctttgtcaatgatatgtcaatacatggtcatatgtgaggcatagtggttaagaacatggataccagtgcaaaacaactttggcttgaattcctcattcaggcacttataagttgtatgactttgggccatttgcttaacttgtgtaaacctgttttcaatctgtcaactagacataatacataattcataagttgttgagaaaattaaatgagctattctctttaaactacttagcctagtactcaatatatgtgagtagctatgcttctaattctcattactattattaggtcataaaatcctataaattttctccagatttatagacaatgatctttattttttcttatttttgtatgtacataaacttatttaagtatctttggggaaaagcattctgtagagaagtatgtttttactacaattgtctttagtaattgccgtgccccatagagttctttgttagacatgttacctaaccagctctatattttttgatggtttgcattatatttatgtattatcacaacttctgctttaacttttatggatgggccttactgtctagattatgcttatctgaatttagataaagaaagcaggtgcctcaaatgatggccatgtaattgcatcaaaaataagctatgacctttcttatgaaaatactgtgccaaggggcacaaaactttatccactacaaatgctgatgctgccagacattgcacatgagttggactttaagcccccttccctcacacagactgagttattttggtgaatatggttaataaagtgttcaggtacctctttacttttgaaaaacattatttagtttgcttcctatgttgagggtttgatatttaaagaaagatacgattcagatcaataataaagtacacctttaaaaatattttaaaatgtatttgtagctaaagtaccccatatattcccaatacagtattatcattttccaattgtaaaatgtgatccgagtttctccattatcagttctaagctcttctttactcatccttattcttttcttttaaatgcaattcactcctcagactcttgaaaagtgccttctatatgtcaggaaatattacagtttctgaggatataatgacgtatcttatgtatcagtgttatgtgagtgctatataaaatataacaaagaatgggaagggaagggatctgatggcactgtacatgtctcaagaaaaccacaattaattcactaacatgttacaatagggagggactttttgtacccaggaaatgctttctgacaatgtttaaataaaacacctactattactttcttatgttcttaatgtccttaaataagcatcattgttccctattattcatgttgttcatttaaatgatactccgtgattcattagaaatttatattggagtacattttccgaagggattttcttaagttttcgtattaataacaaacttttcaagaccaattattggattatttttccatttccttctcatgtataataacatttctaacattccctattcatattgaagttatcaaattattgagttccattttagtcctttttcactggtttggaatatgtactttattttatcttataaatatttctctatacctctctaacaataatatggtggaaacattagcatagtttaactctgaacctacctcttccgttttccgcgttattgttgcctcatatttcattttcaccttatttcccccaaattagtccatataattgctgttgctgctgctgttgttttaactatttcatataatatttatttagatttaccgatgctattttcccagtttttgtgatcagttttgccttttgttcttccctttgcttctgtgttcagtttctttcttgctctttccttgagtgtgagtagcaaatgtgttcagattttacatattgaaaatgcctttattttgccctgagtattggataatgatgcagttgagcaggaaattatgtaaggacaggtttttttttttcctacaacactgaaaatattatttgtcttttgaaattttttgcctttaggaaatctgctgtcaagttattgtttctttatcattttctctggtacctttaaattttctcttcgtcctgtctgctctgcagtttcaccctattttgtcttctacagtttcactcaactttgtctgtgtgtaaatttgctttcatttatactttgtcacctggtgtgttaattagaacagatacgttatttctttagtggttctgcattgtctttgtgaagattttctttttcccaatctcttcattccttcctaagggaaaactttcttagagctattaagactatccccttcttatattccagttactggtttccctttaatattttctatattcttatctctatctgctcaattttggatacttttctaaaatctgtcttccaactctcaaattctcgcttcagctgcctgtggcgtaatttatccttcaatagagaaatagtctcatctttgtctgtatatatatttatctctctacatttatgtatgtgtgtttatattttttcaaaaaacatattttccatttctcaatattttattgagttgtttcacaaatctgttctttgttatggttttcttcttttttgtgattaattctatgtattcctttaaacaacttaaacagataccatctgtttgactgaaatgtttcaacttaatgagtaataaacatgacaccgtcttatttttccaataactacacccaactctgtcaaatttcaccttctgcctggtagttggcttctttaacaatatttctctgggatctcattactttttattcacttttagttattaaaatgtactctaatttaaatttaaatatcataacttaatcaaatatttcacaagtttagattaatctgttgcttcagcaatttatacagacgcaggagtgagaataaatggtctcacagtctcctcctccatcccagtttctggatacagatctactgtcgatataagggagggtgaagagggaaaaatactctcttcatgtgaaagtcctttttttgctgctcacaactgctgttcccttttgttaaaacccacacacatctataatgcctagtctgttgtccctcttctatatattatcaccactgacctggctcgttctctatagacttgattcgctctgttgaggatccagattggccttattcatatgagctttgaaccccccaaaaaagatctcctaggcttttatagtacctcgtagtgtttaacaagaatttcaagctgacgcttgtcaacagctttacacaaactgctcttgaatattatgtctttttaaccaatgctttagtgatgccctggagtctaatttacctaccatatctcaactcagagcctatgggcactggaagtacctatactccgtacctttcaggaatgagaagtttgaaagagttgtttttgattccttcttggccataccaacagctcaacaggaaatgaataccaaccaccccttcctgaatatatccacccagtagatgagtggttttgttttagatcctgtaaataaaatgattcagatgagtttaccctacctatccccataaaagggtgagaaagaagaattgcctaactattcaaactctcttcacctcactcccctcaagtctccgtcagctctctctgtttaaaccagggcttgtgaaaacaagaaagagatgatctcccaaaatgaaatgtaggcaaccaagccctttttcttaggtgtgaattccacttgccagtctcaagcaaataaactctatgggaaacatacaccatgaggctaggcatatttattgtacagttctccaaaattgttctattatctttatgtcataaggtatggattctaccatttgttacaactaatgactccctctaatggaagtgaatttccccatgtggctagtaaggtttttgtttgtttatttgtttatttgcgagctcatctataataggaattgcctttactggaatttttgtctttttttttctctgggctattgagtttttgtattgttgccatcaggattgtagagattttatgctctgccctcatgtgtgatacaagcttaagtttccgtttgttatgggtggatctttatttttcagcccaaaatcccccaacaatagtttccttgctaaatcataatattccaatggctagggatgttctacttcttccttacagggtggatggcacactgcttcattctttcccatttccctggcttgcctcatttcccatctcaagttagtgttaaatgccccagctttgatgtcgtataccctgttctgatacgccagtatttttataagcttgattttccactttctactttcatttccctctttttctttctcacacctgaggttctatatacatgttttacagatcagctatgaattaaaaatgtttcctttgtattttaacatgtattttggtataactgaagcaggatatgttgggagttacctcatcagctccatctactattttgaacagaagtttagttttttatttgtactttccttcaaagccactttggattctgtgatttcaaagtaattttaagatccaaactgttaagcttaacagttattctaagtggcttttagctccaattcgggcttcaagactatattttattttgcaaaggtgacctgtaaagctggtacattcagcctctccagctgtgtccttcagatgcattgaggacagaagaagctatccattctgacagttaaatcagcaaggtagttcattacctcaatctgcaccaaagttaataagacacattaccaatcacgtctccttgtcttcaaagctctaaggtaccctcgggtatttaagaagatatttatattttcccactgggatctttgcccagaatgaagacagcctgtagtccagcaggagctggaaatgacccagattttagatttctatcaccttttaaagcaaaacacttaatttcactttttgcaataaactgtacataagatatcaagcaggtatgaaaggttggtacgtttgccaagcaggtgagactgatacttttcatcagatagagatcgaatactctgtgtcattctaagggctatgaacatagagaactttgggaaatctgattaattttttagatccttctgaaataaatcttcctttcaagcctttaattttggtggtagtgaggcgggggcaggtggtagtaagtggtgatgattgctgcattgtgtttactgtacttataggttcattcaacagttacaaagctaacagaaaatgaccgttgttacattcttatcctctctcgcatcttcctatcttttccccaatagacataatcaccatctagaaagctacctttgttattcctttgtttaaaaaaaatccacacacatatgagtgaaaaaacaattgtgcttaatttcagtattacagtaatggtaaactataatatagtttttttagggctttgtctttcacccaacatatttgtgtctgagattcattcttatggttctttttgatgagatttttcattgtcacgtctgtattctctgtttaaagatgacggtatatttttccattctccttgcagtggacattatttccttttttttgattactacaaaaagggctgaaatgatcattgttgtaacagtcttgttatccatgttaaacagtttctctgaggatgcacatatcaaaaagtggagttgttgtcttgatgggtatgtgaatgttcaccttattgagaataacaaattgttttctgaaatggccatttcagtacacacacccaccaacaataaatacaaatttttgttcatgtatatcttctctcacacgtggaattgtcaaacttctcatttgtgtcaatcaacatggtatctcattgtaatcctggcctacatgtccttgattactaatgagattgaacatatcttcatgtttaatgtatatacatatttctctttaagattttggttcaggttttcttttcattatcgattgggttattcatcttctatttgacttgctggcatttttcatattcttatgtgttacagatgttgcagttgttttcttctattttgagtctgtttttcaattacttgatggtgtcctttgatgaatagaaggtcctaattttaatgtagtcgaatgtattcatctcttttttcttacggtcagttttttacgagatgtcttacttaagatattcttctctatgccaaagtcagaaatattttcttctatattttcttgtagaaattttaaagttctgcttttttatgagtacttctgtgtataaatcagtttcataatacaaattaatggccatttaaaataatcaaacctttgaattagtggtaatatttccgataatatacctcaaggaaataataagaatgtggaaaaatagtccatattcacgatgatgtttaccataaatttataatagcaaacaaaactaaaagtagtctatctaaaaaaaggaaattgctaaactaagatagagccactttaaagaagtcttagattttcattaaaaatatgtcttcttagtaatacagaaaatggtatgatataatgtttagtgaaaagagagctatagttaaactcacttaaattttaactatcaaattatatatgataaatttcagaggaggtcacagaatactggtaacagtgatgtgtgagggagttagatttacatatgcatttttacatatgcttttatttttctgtttcccagactgcaatgttggtgcttatttttattttaaaaagtaaattactgtcttttgaatttattcattattcatgtaataaaatgttttcttaatgacttttgattgtagaggtattagatgatgaaactgtctagctgcattttgaattacctgctacaaagtaaaggtgaaaaatacaaagtgttatattttcagaagttttaataatgaaatggcaaaatttcacatttacttttctaccataatatttaatctgtgatatatatttctttcttaggaagtttgggcatgttggcatgagttattgtcatacttggagaaagcaaacaagtggctaaatgaagtagaatttaaacttaaaaccactgaaaacattcctggcggagctgaggaaatctctgaggtgctagatgtaagttgtaaattaagccaaatgatgataatttatatgcagtattaaaagaggtcaagtaccaaatagaagacaaatccaaagaaaacaacccaagagagtataattactatgttatcactcagcactggtactttggataaagcctttgttccccctaataaccttctaggtcacaagattttgcaaagggtttaaatggcttctcacagaggaaatttgcctttattatatcactaagttctacatagatgcttcacctaattaaatgtaccacaaacctgcaaagacagtgtgaataaacaaactcactgctttagggctaatcgggatgataatatgaaatattatttccagtttaaaagctgcacgtattgaattggaacctattttatacttacttaaaatcacaaatttacaccttacggaatgttttgagttattaaatggatatgctttaatattggaaatatatctttaaagtattcataaaatgtaagtacatttttaagttttactttggagactttcaataattaaatgagtttgcatttataaacttgactttaacttctgacatttaatcattcaagctctatgcattttagtgtacttttgacttatctatatgtaatgaatatgttgttttagaatatgtaatatatgtacgtaaagctataagtagtatagcccctctgtaaatctataaaataaggagcataaattattcaagatgtgaagaaaatgtaaggtatttctttagacagaatagaatttgtaatcctagaacatcagagtagacacctatagatcattttatccaacttcctaattttcaaaaggaaattataaaacctgaaaagatattaaagtacaatgaagtagatctccagtggactttaattttggctctatctgactatgactataaatttgtcgtattcagagaagttaattgaccaaacatttcttgtgaatcagcaatgtgttacatgttctagaaaagttgcagcaaatttacagcacattaataaaaggacagtggccagaacagaagataggatgatgctgttagcctatgaaattgtcaaatcgtacatggagcaccatgctaaattcttgctctcacagtttcagtgatgtgctgaaaaactagggcatgttcacaaaggaatgttaaggaaagagagaaaatttgaagccataatgaagagcatttagaaaagatggggaaacaaaacttaccattactatttactattttagacgaggccctcacaatgcccacaacacagacaagcagggaggaggaaaattgcgagtgctcttatcttttatttctatgttgtggtcataatttcaaattgttcctaattcagataatggagccaataaatgaaattccacagtgaaaaaataaataaatacatacataaaattggctctttggtagtgttgctgatgcttatccaggaggacattttgagtgaaaagggctagatcaccacgtatcaaggatagaaaaactgcacgacttctaggttttcttgcaactcaagatatttataactgatcccttaattttgctttgttgcttttcatccacctttaaaaaaatttaacaaggtatatactttgttaagacttataaaataatgtatccattaaaattatttatatccattttgcaaataaatatttacaaaattaagatttgttagaagtaataaggaatataaattattaggaaaattattaacaatcacattgttctactcaaaaatttgatggcttttaaagtattttacaggttatagtgattttttttaatataaatgtatttaggaagtctctttattttcttgaaacttaataggacaatgtattgagtttgctcaaaattcaagaaaaatacataaacaggaaaaattacaaatatgtattggaagattttcatttttttaaaacaaggaaaacagaagatttaataaatttgtgagaacatatgcccatcacttattttatagatatgtttgaggtccagtaagatgaaattgaatcccttgttttctggcatgcctatgacactgagattcactttcatcatattatctagccaggcaactttgtcaattttgagcagtataggagatgggtattattgggatgtacgtaacagagaatcagacaacggtttaagctcacaaaatgatcttttctcaccacgaaaagaatagtgaagggaggttactcagggttgaggatggttcagccatattatgaggcgagtaggcactctctgctctctcttcctgagcatgaaggacctcacactcaaagtcattgcctcccagtgcaaagatgattgttatacctccaggccatgtatgtgcaaaaaagtaggaagggcaaaaggattcttcttgagagagtactctttttcagaattgtgtcacgtggacaccactagctatcagagaagttgagaaatttagtgttttacctcttctggttttagagttaggggacgtcaaggaaaaaggtggttgtgaatcaagttttaagttctcagtccgcaacactgtcataatcccatgaagattcatatagaatgacatcctattttttgaagcaaaaatgctccttggtgtttttaatcccaattaaaatttgctttaaattgattatgacttaattatatgtaaatcagaagatactgagcatttgctgataatccaatgtatttagaaaaaaaaggagaaatagtaattattgcaaatgtgtttcagtcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggtatgaagataagtgaaaaatctctttaatctaatttgcattaatgtatagcagatacaggcctctcagataaaatgagcaatagtttaaatattagctcagctttcaggtttcagagacaatccaatgccagacactgggtaaattctttacatgtgtattatagcatgtgatttcacaaaaacattgtaagttaggattcttaaaaggcaactgagacatcccaagaaggttactctgaccacagagttcttttccttactcaagatagaccagtatgtgtgggtatcctttctctctcgctgtctcattttattcctctccctccattccacacacatttgttatgtcacatgtaatctgctaataatacatgcaattctgttagtaccccatattatttattcttcataaataacactacatttcttatagataaattttcatatatcacacatggtgtgatttttcaaatcaaaactaaaacaaaatagcaaatttctcctagtcagtgttttgcatactatctcctaagaatggattatttgtcaagaagaaaacccattttataatgatgtttagttttatattcacttactgagtacatctactacatgtgagatatggttctatggtttgatgagtaggaaaaatttgctaaccttcataacttaaaaacattggttagttaaggaagagttactgatttcctagaatgtgcaagacataaaaacaaataatataacgtatgaagagaaaaaagagaataagggggggtagtaactagggtagtatgcatgaaaccattgactaatgacttattgaatagtcaatgtcggggaccttttgacatgcttacagattgaaaaggaacgccttgagtaggaaaacctcttctctatccaattctgaagagaagtatgtgagggtagggcagatatctgcaaatgtaccagcagcacctccagtcttgaatcctgggtggcatatccatattttatccaaatcaacataaggaattggggattggaaaaggggaattccaaacaatctctggtccttcatcattgttgcactattgctggatctgagtcaaatagatattgctatgtggcaagtaaattgaagatcatttcaatgtgggttgtgatatggaattggaatgtgtttttatttctatttgaatatcagtgtcaggtaggagacagcagttgcatcaaaaaattaaaagtcattgtgaaactgaccttggcttagctgtgaaaagactcaaatttttttttttttaaagacagggtcttgctctgtccctgagactggagtgcagtggcatgatcgtggctcactgtagcctcgacctccctgggctcaggtgatcttcccacctcagcctcctgagtagctgggactacaggtgcatgctgccactcccggttatttgtgtgtgtgtgtgtggaaatgttgttttgccatgttgtccaggctggtcttgaactcccgggctcaagctatccacttgccttggcctcccaaagtgctgggagatacacctggccaagatccaacttcagtgtttgacatttttcagtactcatctattctgtccttaggaatagcttactctctaacttgatcttggtattaactctattaatgtaattatattgcaatcctttattaacacaaaactacttataaccttctattttaaaggtttttggtataaaccctgacatttcccccaaagaaaaaataattcatttcagcaacataccctgattcaacacgtattatcttattttctggactgagtttttaaagcataaacttttgaataagaaaatacttgaaacttgggctagaataacaccttgtattagtagtcagggtccagacagggcacagaaaccactcagtcacttaaacagagatggtttaacacaaataagtattaactacttactggaaattaatttttaataggaaataaaagagatctctaaagaataccttaagcctgaggaatagtacacaaacaaggaactaatatggaaagataggagctcaacccaaggctggattcaaacttctttagaaagtgtgtgtctgcctcccatgggatgacagagaagtttccttcattgacccaatccagaacaagtctatagccagtgagctgaagctagtgtgaagagaatattggaggggaatgctgacaaaattcacagggaagtagcctatggtggggaaccattgaatttgctagaaagctgtctggtgtattcattggacatggtgggaaactacctgtagtggatgctactaaacttgaggaaatgaggtggggctccaggaagctgcctatggatttgccacccatcctcaatttgcttattgggtacccatagaacttgtcaaacacgacccatagtgttgctgaaagtcttctgggtaaagtggggtggatgaggtgagccttactgggcattccataggccagcccagagtcacaggtttgaaaaagaattaaaagcacactgggacagacaaacctctacctcccccattgtcactccagcatcctttactgacagaacttaatatcatgtcagctggcaaggggagaaatgttcccgtgtcaaaaacaggatcatgttgaaaggcaaaaaattgataactggcaaatccctctgtaattcactggctatgtgattttgagtaacagttttaaacttacgtttcctcatcctgtttcatagggggttttttttgtgagcaaaatataaaatacggcacttaaagtactatggttccaggaacacagtacatattcaataaattattcaataaatttaatacatgatcagcctttttattttgactagatgatattctagagtatcagccctcaaaaattgtgtgtgtgtgtttgtatgggtgtaaatatatatatatatatatatatgtaagtatatattaaaatatgtaaatatatatttaaaaatatgtaaatatacatatatatatatcccactgagggcagtgattggtaaataaatgcagatagtgcaatatgaaatataatgaaatgcacatgcctccattagttaaataaaatgtgaagacagataaaaaggatttttatcaccctctaagtcttaaaatcagaagctctccacttgtacctcaatgattaagcagagtgttaaaataacaataaatctaaaataagtaaacttgaaactattatcagtcctagctgtgtttatattacatatttggccagtaataacctgggagttatttgacaatgaaaataaagcatatttagtttttacggctttcatgaaaaccacatcatgttaaacataatatccttctcaaattctgttgtatcagcctgtgataagctgattagacctgaaagatacaatgttaaattaaaacaatgtgtagtaataggacttttgtatttctcaggctttgctcagcactttgatcaatttcaaactacttaggtaaaaaagacacacctaataatttattagctaaatcaatcctttggatatttccactatctagttaaaaagactgttgtttcgatgcagtagaataagccttgggataaattatctgagaggctgaagaaacaaaatgattacagtaactgagtttttaaatcaatttaaaaaattcttgttgtacattaatgtgttataatcaagaattctgaatttgttttaggccatgattctcttgatttttggttggttaaacaaaaaagtttttattttgtggttattttctatttttattttattttatttttttgagacagagtctctccctgaagcccaggctggagtgcaatggcacgatcttggctcactgcaacctctgcctcctgggttcaagcaattctcctgcctcagccagatttgctattaataaacaaagtgccttttaatttgaagatgagccttaacctattttttaaaatcaattaagtgcctatgtcagaggtttgtgaggtttttatatcacctacctaatgtttcttatagctgcaattatgcagaactaaggtaacattcaattgcctgttaaatcagtcaaacagccagacttttattgcctatgaatatttaaaagagatttgctagatcccatccctaatttcagagtgtgagtttgcattcaaataagtaataaattatttccatcacttcaaaaggcatctttcattcttgataatcatatagcactatattttctactcacagtaatgatttgaaagatggttagcaaaccaggcaacatctccaacagacgtaccaaatcatatcatttttacaactattgtaatagctttattctctaacagggtaaccaagcagcagaagatgatttagtaatacaacaaaatgaataataatattggtaatagtatttggttacagaggctcaggtacccttttaattgtcagatatgcattttctcatttagttctcacaatagccttatgatacatggtggtttttgtttttgttttttctttttttgagatggagtctttccctgttgcccaggctagagtacaagggtgcaatctcagctcactgcaacctcctcctcccgggttcaagcgattatcttgcctcagcctcccgagtagctgggattactggcacatgccactacgccaggctaatttttgtatttttagtagagatggagcttcaccatgttggccaggctggcctcaaacacctgacctcaggttatccgcccgcctcggcctcccaaagtgcttgaattacaggcgtgagccaccgcatccggccgatatatggtttttcatattcccattctacagaaattgaaaggatattaaaggccctaggaaaaagctattgagcatttagacccatctctttacacttgaagcctaggcacgtgaccatttggctacactacctccaatctctgtgacccttttcatatattaaaaataaaaactctgctaataagtgaatatggcaattaacgagtttccccgtttttaaggaaagcttaaaacatggccttaaaagtattatggctgactaattaaaataaaatttagagtcttaaatattaaagtcacacattgagaagtccaaagcctttaccacttctcttgatgagtgattatttcacctctttcgtggcttattaatgcccgtatttcagtccctttcaaagatgtctgtaagttgttatgcctgacatgaaatagcaaatttactgaaagggacaaaatctaaattggttaattcttctgtaatagtaacatttatgatagactcagagagggccgtattaatttttcctggtaattatgactttgaatttttccctcagtgtcacatctaccttagcatagatagaccagaacggaagaacattgcttgaaggaagactataaagtaatctaggaaaataagtggcatattatgctttattaatttgtcaatatgttttgtagacaatatctgtctataataatagtaaaagccattactttttgagcacagttttacgtcagtccttttgctaagccgttagaagcaacatcaaacttaaatcccacatttgctttatgaaatagatttgattagcttacttcacagttgttgtgatagggctgacttctgttctcaagggctaggacagctaagtcttctgtaatgccctctggaaagcactaggatgctggaaaatgtctagtagttgtattttatgttgctttcaaagaagtataagtaaacctttaaaggctaggaaaaaaatcagatgaaactgaagtcatgccgtaacatgcctatgaccactgacatttgtatggtggagataaaagctaagactgggaaccccaattttaggtgaattaagtcatttgatggaaaagaaatatgatcctctggctcacgaaaatggtggagctaaacacagattccacataaaactggggttctatcagtaagataatgggcagagagaattctatctgcagagagaacaaacataaaaagacatctgtcttctcactgtgagtgcaaagtaatagaataattataataatgtcacctgaaaatgtgtgttggcctattcttgtaaggtgaggaactcttgagtgtatattatcacaaagggtaaagaaatatccaaacaagtgattaagtcagggtagcaccaggttaggagcgtcctagcattagttagaagcaaatgcaaattgtttaccatgaaaagtgccctcagtgtcctcacagattaaactcaggggaacttgagctcatcataaacacatagacatacacacactcactcacacgcacaagaaaagccctcatgaagcacagtcagcctatacaacgaacggtgagtttacttctagaattccggatattagaattgcaagatgtatagtataaaataaataggtaaaatattatagaaataaatgttattgaagttataaaaaagaaaacattgtaaaaatggaataaagaaatcaaaattaaacaactacaattaaaaattagaaaatgaatatatcatatataaacatattagttgaaagaaatgatttaaaagaaaactaaaagagaatgtacagactgtgttaccaaaaactaaggaggtggaagatgtgaacaataggtaatagatacaggggtggggagtagaatatgaacatataacttatctcaatgggagttttcaaagaggagaataaagaaaatggagattattattattcaatataaaaaaattatataacccaatttaaaaatgagcagttgagctcaaaaggcatttcttcaatgaagacctacatatggccaacatatatatgaaaaggtgctcaaactcattaatcatcagggctatgtaaatcaaaaccacaatgatatatgtcttcacatctgttagaatggcagttacttaaaaagaaaatcaagagatgacaagtttggcaagaatgtggagaaaagggccccttgtaccctgatggcaggaatgttaattcatgctgacactatggaaaacagtatggagattcctcaaaaaaaaaattaaaaatagaattactatatgatccagcaattccacttctagggatatatccaaaggaaattgaatgagaatcacaaggagattatctgcactctattgtttattgcagcattatttacaatagcaaagatatagagacaacctaaatgtccattgacaggtgaaaggaaaaagaaaatgtgatatatacatacaatgaaatattattcagcccttaaaaaataagcaaatcctaccatttcgctgtaacaacatggataaacctggaggacattatgctacatgaagtaagccagacatagaaagacaaataatacatgatcccaatcatattatgaatctaatacagtcaaactaatggaaggagaatgtggaatgcttcctgccaggggctaggggaagggaaaaatggagagatatttgtaaaagggtacaatgtttaggttatacaatatagataattcctagagatctactgtaaagcatattgcctatagttagtctatttacttaaactttgctaagaggatagaccttatgttaagtgttctgttacagaataataataatattagaataggaggaaagttttggagatgatgaataggtttatgtcatagattgaggtaatgtttttatcagtgtatatttatctccaaactcagcaacttgtgtatgttaattatatacagctttcttgtatgtcataatttttttgagaaatggagatggagtaatatatgaaggatattaaaggaaagtttccaagagccagtgacataaaccacttaaacagaaagcacattatataacaggcaaagtaaataaatagaaatccaatctcagacatatcacagtgaaagtgcagaaatccaaagacaaatttatattagcagctagaggtgagatggataacctacaaagcaattaaatttaggctgtcattagacttcttatctacaacaatgaataagaataaaaaagcaatggaaaatattttcaagatattgaaaaaattaccgtcaacctagaattctgaactcaacaaaattagttcttcagagtaagaggaaattagacattatcagagtgaaaaaaaagtgaaattttaccccaatagacccttactataaaaatgtctaaaataagtatgaagaattagaagtagtagaaaaataagttttaaaggttttagatgcaataagtatgatgaaaaaatagttaagcttttaaatacaaaaggcatttgttgcaaaaaatatataagaatatctaatttcatttaaaataatgttgatctaaaatactagattaaaaacaatatggaggggagttacagccacaagcccttttatttagaaagagggtagagatagtgattaaatgtcgactttatgctgtaataaattgtcaaggataaccactaatggagcatccacctgggaaacaatcaaagaatgataaaaggaacagttctcaatcagtacgcagtaaagcaagaaagaaggaaaacaaaacagaaaaatgtgagatgagcataaaataaaagaaaagatggtagaaaaatagaaatagaaaaaaatagatggtagaaaaataccagcggccgggcgtggtagctcatgccttaatcccagcactttgggaggccaaggcaggcagaccaggctgccaacaaggtgatacctggtctctaccacaaatacaaaaaaaaaaaaaaaaaaaaaaaacccaaaaaaaagtatccaggcttggtggtgggtgcctataatcccaactactcgggaggctgagacaggagaatcacttgaacccagggaacggaagttgcagtgagctgagatcatgccatttcactccagactgggtgaaagagcaaaactctgcctcaaaaaaaaaaaaaaaaaaggaaagaaaagaaaaagaaaaaaaaaatacatctgtagtcctagaactatttgctcaatacatttaatatataaatgtagaaattttcagaataaagcatcaaaattcaaaatacattgtttttaagaaatacataaagacacatatatcgaaaatggaaacagattttccgaaaaggattaatcaataaaaagcttagacacctaatttatttccagcaaaatagacattatggtcattatcattattaggcaaaaaatggagtaaaatataacagttctaaaacttgtacatacctggccgggcatggtggctcacgcctctaatcccagcactttgagaggccgaggtgggtggctcacctgaggtcaggagttcgagaccaatctgggcagcatggtgaaaccccgtctctgctaaaaatacaaaaattaaccagctgtggtggtgcacgcctgtagtcccagctgcttgggaggctgaggtgggagaattgcttgaatctgggaggcagaggttgcagtgagctgagattgcagtctccactccagcctgggttacggagtgagactctgtcaaaagaaacaaaaaaatctcgtacatacctgggaaaatacctttaaaacacgtaaagcaaaaatccacagaataacaagaagaaatacacaactatatcagcatggtgggagatttcataatgcctctttctttcaagacaccagacaaaagttagtgaagatagtgatgattaacagttgataaggtggatataaagactgtatagagaaccccaaatcagagtgtaaatttcatctgaagtacatggaaatgtcaatacatttcacatatttggtattattagggaaatactcttaaatttgtaacaagctagaatcaatagtaaaaacttgactaaagtaaataatttgtggatcaaagatgaattcaaaatggatggttaaaattcatagaaccgagtgataataaaaataaaaattaaaactaattggttcctgttaatttttgtagaagagacggaagggctgaaaactagtgagctaactgcccatctcaagaaaatagggaaaagtataataaatgcagagaaagtaaatggaaagagaagaattcaagagcagaaataaataaaaacaacatggaatcaataaaatttaaatgcccatattcatgttttaattagacaaatcaactgagagggaagtaaaaacaaatataaaatcttaaggatgaaaatgttataactacagttataatatatttttaaaatacagaaaatactaaaagctatgcaaataagtttagaaacttacatgaaatggatgaatttctaggagaatattgctacaaaaatgatggaaggggatatagaaagcctgaggagacagaaatttaatcacaaattaaaagtcttcctacaaagactatattagactgaaattattttacattcaaatttgaacacactttctaggaatagataattccagtcatcaacaaactcagtagaacatacaaggcaatatacatgtctggaaaatataaggttagaaaatttttttttttttttaccaaaatcagacaaaaatgaaacaggaaggaaaaccccatgccaatttcagtcataaattaataaggaaaagttctgaaacaaattattggccaactggatccaagtgtgtatgaaacagtgtttaagcttaatgttctccctttcctttctatattcactctttataatactttatgcagtgtcatggctttaaataaaatttacatgctaattattcccaaaatattatctctggcacagacttttgcccttaacttcagaccatatatccagccttctattgtgtatttttctctttggatatctcataggctactcaaacttaacatactcagatgacagctcctatcaaagctacccaacaccgttttctccacctctgttaatgccatctcattcctgaaatttctcataccaaaacttttaaaatgaactttgattcttgtctttctttaccagcctttctcttagcagatctgaaagatggtctcaacagatctagctgttgttttacttttatgttctgggtatatatgcaggtttgttatacaggtaaacagtgtgtcatggggggttggtgtacagattatttcatcacccaggtaataagcatactacctgataggtattttttctgatcctccccttcctcccattctctatcctcaagtaggacccagtgtctgttccctcattgtgtccatgtattctcattatttagctcccacttataagtgagaacatgtgatatttagttgtctgttcctgcattagtttgctaagtagaatggtctccagctccctccatgttcctgcaaaggacacgaactccttctttttgtggctgcgtagtgttccatggtgtatatgcaccacattttctttatctagtctaccatggagggcatttaggttgattctgtatctttgctattgtgaatagtgttgcaatgaacatatgtgtgcatgtgtctttgtggtagaacaatttgtattcctttggctatacacccggtaatggggttgctgtgttctgtttttagctctgccaaactgctttccacaagggctcaactaatttacacccccaccagcagtgtataaatgttctgttttctctgccatcccaacagcatctgttattttttgacattttaataatagccattttgactggtgcgagatggcatcttatcgtggttttaatgtgcacttctctaatggttggtgatattgagcattttttttcatattgttggccacatgtgtgtcgtcttgtgaaaaatgtgtgttcatgtcctttgcccatttttaatggagtagagtttttaaaataaatttgtttaagttacttagagattctggatgttaaacctttatcagattcacagtttgcaaaatatttctcccgttctgtagtttgtctgtttactctgttgacagagttcaacagaggaactctgtgaggaagttgtgtaatttaattaggtctcatttgtcagtgtttgcttttgttgcaattgcttttgacatcatcattacatcttttcccattcctatgtccaggatggtattgcctaggttatcctccagggtttttaaagttttgctttgacattttaagtctttcattcatcttgagttgatttttgtatatggtgtaaggttttattcttctgtatacggttagccagttatcccagcaccatttatggaatagggagtcctttcctcattgcttgcttttgtcggctttgtcgaagatcagaagggtataggtgtgtggcattatttctgggctttccattctgtttcattggtctatgtgactgtttttgtaccagtactgtgttgttttggttactgtagcactgtagtatagtttgaagtcagctaacatgatgcctccactagctgtatttctttgctccttctctcattaaatatagtctctgtgttccaaagtgaggaggaacaactgtgagattaagatttggtaaaagagaaaatgagcagggcaaatagagacaataaatctgtgatgatgaaaaaatgagaaagaaaggccagtaactgaaattgaatagtaatagggcagaaaagatgtgttgttgattttcaggataataaaaatttaagcatgtttgtagtataagggaagatccaatagaaagacataatatataagagcaaagtcttacaagataggatacacgagcaaaaaaaatggaaggattgactttggaagtgggaaagagaaaattgagataatacaaggaggttctgaggtggagagtagtaagtttgagaaagtttatccaccaaggataaatttatccctgagaagtaggtaactctgttttcaggttgtttaggactctgcacggtaaagggggttgggagaaaggagaactggtgtcattgaggaaatgagagtgaaaagtatttggaataggagctcttttgttttaaagattcgtttaaaatcaggagaagtgttagagaataatatcgtggactcagtagtagccaatgaagttattcgcaatggaaataatcagttatctgactttctcccgtaattttctgcaaaataattttatttagaaccacacacatacagccgcatagaaaatcaaaagcgaagggatttttctttgcgttatctttgattagcatctccaggttgtatttgattatattctgaaacaactaggattctagtctgaagtatcttcttccaactatattcatatttgcaagtcattcatctggttaccgccagtatgtcaaatgtgaatttcatgtatttttttttttttttttacaatctctctaacttaaccaatttaattcagatttttatgtcagtcttttagctgttggctgtttttcccaaaatgtcaggatcggctccataatttgggggactcagggaagaaagaaaatactgggtcccatactcaaaaattaagcattgtaagatggcaacagcagagcattaaaccaagcatgggctctcctaagcatgagttactgcataactgcacaggttgcatggctttgaagccaatttcgggtgtcatcttatacatttggttatttgtacacctgaaatgcttttgataaggtttgggagttaacaatttaggctcacttttatagattatcattacttgaaaatatttcattgaggataattaattaacaataaatgctttaatatttagaaaggtgaaatttaatcttattcttagtgtgttaataatggatatagcttctaggtttacatctttccatactttgaattcagggctttctttccttaagtagtaaaaaggatattggatatcttgaatcttgacttctcctaggttgaatgctctgcaaaaaacctttgtctttatataaaaattgcactgcaagcagactattatggcagacctctgtgttcaaggtgactgcaattttcagctgagtggtggactatgcaacttgttctcataataatattaattgaataaatggtcaagagtgattacattttgaggggaagaaacccacttgtgtaatatttacacatagataataaactcaatagcccagacctctttaatgtaagaaaaatagacatgaatgtgtatgctattttctttgtaaattagaaatttttccttctctatttcatgtatcttcttttgttatttgagaaagggatttttcttgtcctaccatcaattgtgtgagttaccttgattcttgtttttaataatattttaaaatacatcttgtattttaaatgtagttaccctctattttatagctacaggaactgaaagagtacatagccttcacaaaagggtctgtggtgaatgtgtttaattcttattttaatcaccatgaatcatggattttttctttgtaagtagtaattccattatttttagatataatttaccctacttcaatcaataatgtttccttggacagtcatatttacttttccgaaatattatataaaacagtagttaaatgtttttgttcgtctgtatgcctattatagaatattagcatttttggggtccagacacaaagggacacacaaacacatatatatacttgcatgtatttatatatacatgtatataagcacatatgtatacatataatcatgtactgcatttcaatatatgattaatatttaagtatttaatattcactctagacaaattatgtttgctcttggagggcattaatatctttgtgaatgagtgttaacatatccatttaatggtatcttgtcttcaaatatctcataatttgatagttgagttatttcttctgaagttggaatagcttttctacaagggcctaccaaaaaaaaaaaaaaagaataataaagttggaataacaaaagagggagttaatacataaaggaaaaccattaaggccgaaaaactaatcagttgtaaaagctaaatcagtagtatggattgataaagtagcattttagtgataaatttttggattgaagtttctcttttaagtttatcaatgtaccttttcagaaaaattcctcgagtttatatctttatgttaatgaaacttgtcaataactttaattatctatgatgattgacaactaatacttaatttctataacacacaatactgttctgagggtacatattcatctctctctttcatcttacgttttaccactctcaactttttaaaaccgttttctttgcaagctacttcatagattcttgagattgaataatcaaatctgttatttaatattcaggccaaatttctgaaaatgtttatttttttaaaaaaaatgataaatggaaaagggaatgttaaacaacatttctttgcagtgtattccagtgtccctagatggaatgaggaataaaaatatttttcaagttcatcatgctgtcttttaaatcataaaatgcatatatttattagtaatttttcattgaaagtatcaaagaaaattggagaatttccttactgtttctacctcactatgtttcgtatattctgaccagcattaataccaatttcatagcactctactgttcgctcttttttgctgtaagcccaactgattgcattttcttacctgttatttttcgttgttgttatttaagacatcttttctttctaacttcggtcttcatagaccttctcaatttcagctcatcaccaaaattacacagatagaagaatatagggactttggtgtacacatacccacttttgactccctctgattttctaatttagtagattttaattgaggctgagaactgtatttggaaaagttcattctgatgattattcaggtttgtgaaccccagtctagatagacctttatcagcacatgtataaggtgcactttgctaaggtgcattatgtgtcaggttcattcccactgtggaccagtaatttattcttgcccaaccactgctcatgacagatagatgatctctgtattccagaaatgaagctcctttccaattcctcaacaactaaaccaagcagaggaaaaagtggttttccttcacagccatagttccctgctgaagtagaatgaacgctttctaggaaactgcagcagatttttgatgacacggaaagggcatcactaggatcctcattatatattacctctctccctcacccgaaccacaatgttgacggaacagatacttcctgtggggaagatgctaagcagtcctgcatggctgtaggcattgtccacatcttaatcttcagctatatctgaggtatgacaagtttaacaatcctacaagttaaagcgtcacaccggaaacctgtttattcttctcccatgccaaataattccagcacgatgggtttcatctatagacgatgagaagatgccattgtggggtgaggacatagagaagagaggaagtttggaaccagtttatttctatttcagcaagcttaatgtattgtaagaacattttgtggcagatgaccctagtctgtaacaaggaatcgattgtaatgcatcattctgccagtgtttatctgttccctatgctcatataaacacacgagtcatctttctgcactcccaacctactcctaaagcactatacagaatgtttcgaaagcagaaggaaaagcagctgttccatacaccatgttcctgctgttcaaggtgcacatcccatccaaatgaatcatatcagagccaaagatcctggtaggagttcttttctacaaaactgcagtcttgtctatcctaacaacttggaggacaaaatattagaaaaccttgtaataaccttaggacacaataatgtagatactgactgagctagacctgaggactttttcaatgtagtgtggataagtaagatgacaggaagccataagcatactgtgccttgcacatcaacttctccagagccatgacaatcatctggagtatttgtgataaataaatattgttaatcttcatgtaattgggtaggatgaaaaaggaccagtcgtcccagacatcccaggagagaggagcatttttccagttgctcagatacaatttcaagttcgaaccaatatgaattacagttgaccacagaggccggcaaaatccatggcactgtagtccaagagaacctgaacactggccttagagtattatgagcctacatcacagtagaaggaatccagcagagatctctaatgcacatcagaaaagcaccatttctagttatcaaggctgtatttcacactgcttgactgaagattggaaactattttattcataggcaacctgtgtggccatccttacctggtctataaaaggaagtgtgatgaatttgcttcccatacatcatattaagtccagaaagccagagatgctgtgttgagtttctttcctgagagtctgaattcctaagtagagggactaacgagttccaaagttctttcactctgagatctttgtcacactactgtactgactggatatcactgaccttatttaagaggactatcaactggctagttcatctacattgtaaggactagtttgctcacaaccaccaacctatctgtaattggcctcagtatgctctctctcacttgggtacttctgtatttggctaattaacctataccacttggcttagaagcaccagctacattttttctaattttgacttctcatcttttccaacttgattttatccccagatttggacttttgtctcatgtataaactttatattttgcttgaacatgtggtctcaatgctgaccaagtcatccctagaatctgattctgtctcactattccatatcaggagacagcgacttaaatattttaattatttcctgtatcaataaattattcactgcctaaagtttagactttaataatatgaacacatgtgcagtcaaagagtacctcgccattgggccggaaaaatttcactgacttagggtggctcctgaaggtaccttgagaaagcttggatatgatgaatcctgtagacttattttatgtttactgaataatgcttcattcactttctttttgaagcttaaataaagcatcagtttgctcctgtcagggcagaagaccaatttcacttgtctacccatgaggataaatggatgcagcaagaatccagaaatgtcttagatatattactctatagctcattgaccattctatcaatgctcaatgctttacttgaaagtgatggctatctgatgtcaagttccattgataaaatgattcccaaacgttactttcaagtatgcttccttcagaggtcacagaagaacttcagtaacctgctaaaacctaaaacaggtgaagttcctattaaccatgacaccaagagttttcacatttatattctttcctggtaaagaaaattataggagctccatgctcacggcttttgagttttctcccaggtgtgttcaaacctagtgacattaacaaaacataaatctagaagcctttcgtgaataatgtaaccttctttattttatatttaaaggatatatatgcagacatgtacacatctttgtaattatttaccgcctatatccctattaaatacattaacaaatatgccacaggaaaaaccactgtaccaaagcccctcacaagagttatatttaaagtgggttaaagcaacatggttttaatttacttagtctttcttgtccaaggaacacagtgtgagacctcctttctttaggaaaaaataggatgaactaatttgaaaacaaagaaagcaacaaagtgaatcttgtgatgagctatgagcattggtaaattatttcttctgttgtaaattatcctcttctccctctgcttttctcttaatctccatttaattcccttttcaaaatcctaactctattctttttggaaaacatttcattaagctggtataagcatatctagacatctggaaatttttgtataacttttaaaggatctattacttaacaccatatgaaattatggaaaataaagtgttcctatctaatcaatctcaaagatttttcaagtgtacaatacaatgtgtgcttcaagtgtcagcttcttttttttttttttttttttttttttgagacagagtctcactctgtcacccagactgtagtgcaatggcacgatctcagctcactgccagctctacctcccgggttcacaccattctcctgcctcagcctcctgcgtagctgggactacaggcgcctgccaccatgccaggctaattttttgtatttttagtagaaacagggtttcaccgtgtcagccaggatggtttcgatctcctgaagtgtcaacttctttaaggctgtcatcttgccggttctaaacaactaaaaattgtaagaaccaatttctgagacaaatagaacattcttagtggtccttaaataattcctgatacttttatggcatgcttctttaaagaccttagaattatgcttcaggaatttaaattggttgttcagcaaagttaccaatcagtaggcaagttgttgcatttgacaggagcaatagttttcacgtggattatttatattcatgtatgttggtagacggatataaaacatgcaacttgcagttgcatgagacaaaagcatcaacatatctatcttagcttttcaatcatgtgatactactataatgctccatttttcacagatatttcttaagttctttatctcttcagacctcccgtaaaccattttctgtcttctgctggaccacattctagatgatctggatgtctatcattctcctttgcctttgctttatttgagtaagtgctgaattcgtggactgtgttagtagtttgatgcgtagtttcagccagatagatcagaaacatgaaatgcttttacatcatccaggtagatggcgccatgaatagatccctttgctttctggcctctgaggtaataaagacttaaatctaattgggttcagcttaaaatctcaatgtcatatttaatttaatatgcttccttgtttccagctcaagcttaagccatggtctaaaagactttctctggaaggcaagtgtggttagattccatcttacacctccactgcctctttttcttttttttttttttaactgcacttcagttatattattctccaatgtcttgggaagtaggagttaaggaaaataggcaaatgtctcctgttaactagctatttgtagctttgagtttatgatttgtgtgtgtgtgtgtgtgtgtgtaacagagatacaaagttcgggtttatttggggtacaagtatgggatctttaagaagtcttgcagaagctcttttgttttccccatctttaagaaggaaaatatgctctataaaaacatcttcaagcctcttgatcctgaggtactcttgctccataaagagtgttcctggtagatagctcaaacatggctgtcttcttccacgttcacttgacctattgagaaacgtttgccacaccaagcactggggagtacaggctgccccccttcttcactgtatcatttctcattcattttttacctatcaagtaggcatataatttctgaagcagacatcttcagaagcagagttggtaattaggtgtcatccctatctactctggactcccagaccctgtgatcagtggtcttggagctccacttacttgcatgggacaaaaaggttgaagtaccatcttcttttcccccttacggaataaacagagggagccatccctactctccctctgggccatgaattcagaagaccgattctttctaaaaccttcagagagttttagtataagtgggtatggtggagcaacaaaggcagggccagttttcccagctcttttgtaagccctttgctatgccctgctatttccatctcttagaatgagagagacttattacttgttattttcagtttaagactatacccaaaattctaagacaacagatagaattcaatgcattcatatccatagtgacagtttcacacttgctcttaagttaaatagaagagttaggtcaggaggaaatagtttatcaaaaatgatatacacccaccagtattcttagtacttggcacttgaacaaattgcaacctgttagtaggtaaaaaagaaacactaaaaggaaatagttggaccactgaactattgcttgatccactgaagcaagtgttgcttggtccactgaagttgagactctgggaaagaaaacttgactggtaaactctgtgaagtgaagcgtggttgtcaaatggagattaatgtcctctcatgggtctccactgtagtttctgaagggcaggttgagtaggatttggttttagcacatctcttgcaggactcctatcccaagacactttctataaaataaaacatattccatattgctctactttctgcaaggtacggacagtcaggttggggccaattaatgcactaccctaagcagaaacttcaagactttgtcgttgctttgctttatttgaattggaatttgggatttagttttcgttagttcatttactactaaaatcactcataaaaatgagggctttattttgacattggcaaaaatccttctttactcagaagaaaatatttaaaactgctggaaattgaaatgttttacatgtctacatcacaatgatgaatacaatgatgagtatttaaacaccaaaaataaaagtgtcttattacgagatgattgtaaacagtgcacccacattcttaatccatttgcaagcataagcttacccatcacctcataaatgcagtaaaattgctttttgtattgagtttaataagtatagtataggatacctagctcctttaatgaatgtgttttttgtaaaatattattaaatgattttttttctaatttggctttttaaagcatgcattcatatgttaaatacattttttggtttcaatattcggttttttatttcacatgcagagttttctcttccagagtttcttagacatgctacactttgatttatgtgtttgtaatattgtggtacaaaggttagtacattatttttaaaatggaaatgtgagaaactgtcaattcattgtagagatgactttacattgccagcaaaactcattaaactcttaaaactttttcttaaacttattttatatttccatagtactttaaagatataaaataattaatttgtgttaacttttacttagttttaattttcattgaaaactgggttaaaatatattatgtgtttttcttggtaaccattactaggattgttttctatttttatatttttgtcattgatcgccagttattaaaagatgtctttctaactttccttatatttgctgtttctgtctagctatataattcctcttactgctaagtggattagctaaagacatgaaataacattttaaaacaacagcggaacagtattctggaacaacaacaaaaaatcagattatggttgaagactttctacaaacttcattcaatgagacagcacaggtcaagcgggcagaaagtcagaaaattcataagcctgacattccatcagggtgcgcctaatcagatgtttagaaatagaaggcagcttatgccatgactagttgaaagaattctgcaagcttgcattgacatgaggtcttttcaatgactgagataatcaaggaatctgtgtaaatcagcctctcttattgactgtcaggccaggaaaagagccaacccacccgaagtcaactctgccatcatttcttaagccacactgttcctttcagctcatagaatctcatgaatagaaaaagttaggtttctaaaaagaattttgaggctagatatgtggtttaatgttattctatattacatcctatacaattaaaatctacagatgtgccttgtagagtacactgtttttgcctttagccagaggaaggaccaaatttaatacctggctaggcaattattacacgctgtgattggaagttttctccaaccacctgtcacaatgctgaaattttatcactagagatccatttctttggaagagctgtgggtaggctgcagccagtctcctctgcaatagaggctctgattatagccctgaacactgttatctgaaatagtaaattacctgatgtaaattttagttgaaattttgactgagaacaaaaggaagctatgtttgaattggaatatagggcaaagcctcggtcaccaatcttggatacagaattttaatagaaagagattaaaattttctccaaataatgtcccacccccattctgacacttttaatacaaaaacagatagatttattgtccaaaagatacatctctgagcagtggtgacctttgtttacaatttcttctgtaaatccattttcgtctttgactatttaaagttttctgtttttctcattaaaatttctccttatacttttcacccagtcataaataaagctattgggcttcattctaggaactggtattgagcaatgaacaggacagccgtaatccttgaactcattagagttgatagtctaaagtaaatgcagaccattaatgggagattaaatatgttatggcacatacaaagtgcaagaaagaacataatgtcatgtgagggaatgcataaatagcttaatttagccatcccgtaacatattcatatattaaaacatcatgttacgtgctctaacttgatagaatttttacttgtcaaatcaaaaaaatacaaaattcaaagaacatgcaagaattacctccctgaacttagaaggtgccagaggtagccacttggaagagatgtccactacattaagaagataaatgtaaattagccaataaaaggaagtcagaattgagattatgccagtaaaagggaacaacatgtttaaggccaagaatcaagagggccacagtgtaggttgggaaataaaaaataaaatttctgtatagctagagcagggagtaaaagacaccagcaggacttatattatgaagggacttttaagccacattaaggataaagcttttggctgcgcgcaatgtctcacgcctataatcccagcacttagggaggccgaggtgggtggatcatcttaggtcaggagtttgagaccagcctgggcaaattggtgaaaccctgtctctactaaaaatacaaaaattcgccaggcatggtggcaggtacctgtaatcccagctacttgagaggctgaggcaggagaatcacttgaaccagggaggcagaggttgcagtgagcagagattgtgccactgcactccagtctgggtgacagagagagactccgcctccatctcaaaaaaaaaaaaaaaaaaaaaagaatagagcttttatttgaaggacagtaaagaatcactagagaattttagacaggaagccccaattcgttattgagagaacacattgcagctgctttacaggtgggatgtggcagagtaaaatgccagtgaagaaactgatagcatatttgaggtaagatatagtaatgattttaactagagtaaagacaatggagagagagagaaaagattggaatcaagaactatttagaaggtataataaataattagtgattgactgattagatgcaacatgatgaaggacatgatagaggaagtagaaatatctagaattacatctaataaagggaatcattatttgtttttcgctgaaaccggaaaaaatacagagaaggaggaaaagcaagttggggagttgagaagtaggtgagaagagtatatgcaaggagttcatgtgtgggagtgttagcttttggtggttgcagaatattcatgaggagatgtccaatagggtgagataacatgcaagtatggagatcaaggggagatctggacttgagagatgtagagttgagagttgtcagaatgtgaggaggaattgaagttaaggtatgggtagaatgagaagaaaggaaagcccaggataaaatcttaatggagtcaaaatttatggtacagggagaagtactgggaaagccttccctcttcctgcagcatcactaaacttcctgttcttttgccttagtctagatgcctttaactgtagttttacttgggcaaagctgtgttataggctggcttcactgaagaataatgacatcactaatatttttaaagcttaaaaagtatagtatttatgtaatatctaatattctatatataatataaaaaccaagatcatcttaaaacctcagtcatgctctgtgggaaagaaagttatattgtacctgataatcatgcctttacattgtatattaaggaaatgtattttaaatgacacataatgaattcccaataagttgcctgccctatttcttacttttacaactactctgttaaaagtgaacagatccttgaagggagactttccaatctgtgcagcatggtatttatacttgaacattattgaattatcctaatcatacttatagttacaatcaagattaattgcagctatattaggattacttattattttttctacttcagcagtaacataaacccaattgtacaaacaatttctgtaatccaaattgtgaaagaaagtagggagaaaaaagatcatgcaaagctggttgaaatagtattcaaaataaatctttaaccagactgttatctaaaattctgtttttgacaaggagctgattctgaacagattgtacatgtatctcactggtggaagcagattatctgtcttgaattggattgtgatgacgatgaccctattctaagcaaaccaaatctcttgaactatataatgagatcaggaggaacattcgacctgagaaagacagattgcaatgactgagatgattttgctaattttttttccagcctatttccttaatgtacgtgatattgtgattgattttcatgcagagatccctgatcctatagttttgtttgctatttatttttctccttcacattttttttctatcaacagagctgaatgagtgccaggaagctgcgaaatctgtcttacaaaaaggtgattgtggaagagtctagaatcttcatttattgttcagcaggattacagaaaagctatcaagagtaaacatttaactgatacactcttattccttctttttaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccaggcaagtacatctgggaatcagcttccattcttttgtttttattacttcaacaaaatgttgcagtgtttctaactttaaatttattcaactagttttccatggggttgttttgattcactgatttgactatttggaggtaggtaggaagaaaagggggtctagatcattagtctaagatttatttttttaaggatgtaatggaggaatttgaaataaagacatttcaaagacaggagcaatacgttctggtgtttctgacttcaaactatactaaaagctagagtaaaaccataggatagtaaatggtaaagaaaatgttttttggccgggtgtggtggctcacacctgtaatcccagccctttgggatgctgaggcccacgaatcacaatgtcaggagttcaagaccagcctggccaacatggtgaaaccctgtctctactaaaaatacaaaaattagccaggtttgttggcacgcgcctgtaatcccagctactcgggaggctgaggcaggagaatcacttgaacacgggaggcggaggttgcagtgagccgagattgcaccactgtactccagcctggaacagagcgagactctatcttataaaaagaaaaaaagaaaatattttctatggcattgttggaaagcagtctcaaacattttattataaactcctcgtttagtcacatggtctatattgttttataaaaatgtgttagttacaagcagtgagtaacacaaaattatcgatataaatttacacctcaattattaatgatcatgctcaatatagctacatgcactcactcccatgcttcattcaaacgaaaatataaaacgtgtttacctgtttttctagaatgagaattaaaatagtgttgaaaataaatctgagttgacttttaaatgagtaaattttaggccataactaaatttacattcactgtaagaagtatttttaaaatgctgttctcattttttaattaacatttaaacatatgtgaagttatcataggtattatttattcaaaagtctttagggttgtgtgatcgcaattactagatctgcttttcaaatcttatatacatgttgtgaacccaatcaccaagtccatgctatgatgagaggagcactagaaggttagctgcaaatctcaaagccttctccctgccagttggtgaagatgtctgaagtttttcactttaaaatgaatttgggggtgatatattagatttgtagatcatggttacaatgcaattacagttaatgaatcaccgttaataggtgttctgggcaacagtatacacaatagcatgagttaatttaccatattgtctaactttgaccaagaatgtccctgataatatgtggcagagtataggtagttttgataggcttaaaaagtccagggaatattatttccttatggagtgcatacaattgcaatagtggatgaagaaagagaattttggggagaatcctgatgataaaatcctcatcatagttttccactgggcaacaagagtaaatattgtagtagaagtgagggataatagtaaacatacttgaggattcaatttttaatttgtcttgatatataatgattgtacatattttagagggtaagtgtgataggtttatacaaacctactccagtatatatatttttcaaacttacacaagccaggttctctagaattaactattcctaagtccgtcccagtttgagtcataatgaaaaaggttttttgatataaaatatttatacatatttatggatacaacatttatgtaatattttcttacatgtatagaaagtgtaatgatcaagtcagggtatttagtgtgtctaccacggcagggtttagtaaaatgcatgataggaatgagtaattgtttctgaattgagaagaactacatgactataaatgaaatacagagtagaactgctttcatttaaactaatgacatgagttttgaaggaatgtttgattaaaaatgcttgtgacgttctgaatggaattaaggaaaaatttgagcagtatgaatactagacattaatattgcaagtttgtacttcaaaatgcataaagaattactttgtgacagacttgcggaatgaaattatgagtagcaaatttgataggcaaagctattatactattgtctttcaaggaaaattggagcttttagggcgaagcatctttagttgaacaggttgtgataaggggcactgtgtgttttttcttatttagaaatggattcaggattttataaacattacttgtttttaatagcaaaatattttgcttggtttttctaaaaaaatactacaataaaaatgttattaactacatcagtagaaaagtactagtaaacagcagaacacagataaattatgaaatttcagatctacttcaagaaagagattttgggcattcagatcaaatctattttccatgcatttcaggtcacacctgcattatcaacatagttcttgacattgagtctccccaatggtaatacataatattggagaatacaagccatctgaaagctcttaaaacattcttctgctccagggttttattttaatatggcagtaagtgaattgttttctagaacagagttctcaggtactcagatttgcttcaaggattatatttcctgaaaagcagctcgaaattcccatgaaataaaatagagagtcaaaagttagatagtgaaataacataagcacagtgtgtaagatgaaggatccactaagaatgccaccaaaatgacattttaaatatagagatggggtggatagatggatggatgtatggattgatggatggatagatagatagatagatagatagatagatagatagatagatagatgaaagaaagaaaagaaaggaatagaatagggactaacttcaatgcattgtattaacaaaaatgtgtttctataaatttgcacttaaagataaaaaggttattgctaattaaaatattagtgcactataatttcttttctcataaatggtatatttagcttaattcatcacggagaagcaggaaaaaatgtatgaagttaccatattaagtcctctttgaaatacctgctcagattttctgtcatatactggtcacgcagatttgtgggtgtctgactccaccgtgtggtgcactgagagttttgctagttaatttgaatcttttagagcattattttttctgcattttaagatcgtttgagatcctcagatataaaagctatggcactaaggaaatgcatactgtatgtacaactttctgacaaccatactcttgttatatataaaagtagatgtagatcaggatgcttctttacattcacattggcatttattactataggaaagaaaagagctgctcacttccttagtgtgttaattgatcagttatttctctgggccctcagattctgaattggatttaaaattatgttacttattttagtgacatgagcttacctacagaagcaaagcttacacttttagaaaataaagctgcatgctgccaggatgtaacagcatgtgttgacctaggagtattttatttcaaaagataacacttagccaattcacagtctttttttttaatactttaagttttagggtacatgtgcacaacgtgcaggttagttgcatatgtatacatgtgccatgttggtgtgctacacccattaactcgtcatttaacattaggtatatctcctaatgctatccctcccccctccccccaccccacaacattccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccaaggtgtatatgtgccacattttctaaatccattgtatcattgtgagacatttgggttggttccaagtctttgctattgagaatagtgccgcaataaacatacgtgtgcatgtgtctttatagcagcatgatttataatcctttgggtatatacccagtaacgggatggctgggtcaaatggtatttctagttctagatccctgaggaatcgccacagtgacttccacaatggttgaactagtttacagtcccaccaacagtgtaaaagtgttcctatttctccacatcctctccagcacctgttgtttcctgactttttaatgatcgccattctaactggtgtgagatggtatctcgttgttttgatttgcatttctctgatggccagtgatgatgagcatttttttatgtgtcttttggctgcataaatgtcttcttttgagaagtgtctgttcatatccttcacccacttgttgatggggttgtttgcttttttcttgtacatttgtttgagttcattgtagattctggatattagccctttgtcagaggagtaggttgcgaaaatcttctcccattctgtaggttgcctgttcactctgatggtagtttcttttgctgtgcagaagctctttagtttaattagatcccatttgtcaattttggcttttgttgccattgcttttgttgttttcgtcatgaagtccttgcccgtgcctatgtcctgaatggtaatgcctaggttttcttctagggtttttatggttttaagtctaacatgtaagtctttaatccatcttgagttaatttttgtataaggtgtaaggaagggatccagtttcagctttctacatatggctagccagttttcccagcaccatttattaaatagggaatcgtttccccatttcttgtttttgtgaggtttgtcaaagatcagatagttgtagatatgtggcattatttatgagggctttgttctgttccattgatctatatctctgttttggtaccagtaccatgctgttttggttactgtagccttgtaatatacagaaaaagagaattttagaccaatatccctgatgaacatcgatgcaaaaatcctcaataaaatactggcaaaccgaatccagcagcacatcaaaaagcttatgcaccatgaccaagtgggcttcatccctgggatgcaaggctggttcaatatatgcaaatcaataaacgtaatccagcatataaacagaaccaatcacaaataccacatgattatctcaatagatccagaaaaggcctttgacaatattcaactacccctcatgctaaaaattctcaataaattaggtattgatgggacaaatctcaaaataataagagctatctatgatgaacccacagccaatatcatactgaatgggcaaaaactggaagcattccctttgaaaactggcacaagacaggggtgccctctctcactgctcctattcaacatactgttggaagttctggccagggcaattaggcaggagaaggaaataaagggtattcaatcaggaaaagaggaagtcaaattgttcctgtttgcagatgacatgattgtatatctagaaaaccccattgtctcagcccaaaatctccttaagctgataagcaacttcagcaaagtctcagcatgcaaaatcaatgtgcaaaaatcacaagcattcttatacaccaataacagacaaacagagagccaaatcatgagtgaactcccattcgcaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagtgtcaatatcgtgaaaatggccatactgcccaaggtaatttatagattcaatgccatccccatcaagctaccaatgcctttcttcagagaattggaaaaaactactttaaagttcatatggaaccataaaggagcctgcatcgccaagtcaatcctaagccaaaagaataaagctggagtcatcatgctacctgacttcaaagtatactacaaggctacagtaaccaaaacagcatggtactggtaccacagtcttaaattaaattatatggccacagcatcaatctacccagtgtcagctcatttaatgagagattttattaaagtacaaaattaagaaaagatttattgaaacagaataaagcaaatggggaaaactcttctagatatggaaatatatcttagaaaacagaaactaggattatttccaaagtactatgattaaaaatgtaacaacctatgcgtgttccttggaaataaataaaaaattaaatcacgaaattgtgtgactgcaaagaaacacatggaacaaatttagtcatttactgttcaatttttcagaactatatattgaagcacagagtttagttttggcacctaaaatcctatagcaacagtctaagtaaccatgctgagccccggagcaatcaaatcaaatctttaggtggatttggtcttcagaatttttggaaacttttttattcattctaatgtgtagctaattggagaatggctttggatggttccctactagtaatgactaaattgttccagagtatttttcatacgacattttctatcactcttctataaagattctcttctatgactgtgtcaacgtttcaatgggagggagtcagagtggcaatcaaactactggtgagattctctcctattttgattttttcctctaatggaaaatgggtgatggaagaaaatatagctgagagctatcgcacaaattttaatttagacaaaaagaatgttcaatatagatgtttgaggctgaactctgcttggctttcttcaattcatttttttctaaccccatttgttaacatgtcaattaacttgcatatggctcttaatcattttaggggacagtgacaactatgtttaaatagctacttaaatgtcttgcaatttttaaaattacaaagatactttcacatacatgatttttttccttttctactaattttagttttgaatctttgatatgtaagaacaacccaacatgggcacctgttgaaagtcaccatgtccttatgtgttgatgcacattttgtaggggaaaacatggccctgttgcttaaattactgcaagcaagagcggagttgcttagcagtggctccagtagctttactgttctatttgttttttcccaaagaattctgatctcatttttttgtaacctcgtgtcccacatagtagatttatgagcaggaatagaggaaggaaacaaattaccttcaaagaagagtgcctcataattaaatattgaaaaatactgccgtggtttgctcaccaagctaggacgtcaggtgttccagagtccactacagaccagacttcctccttctctttttccctcccattaacaatgtgagtacaatttagaaaagaggggatttttaaagcaaagaaagctattaatttaaactaattacgttaaatgcactttaagaagaattcgtaattgcaatcttcccgtgtttatcaaagaagctaaatcttataactcacattaaatataatcggtcatctttaaatgttaacattccaagctatcaaaatcaatggcttaaaaataaagatataactgcagattttggtctatcagattgagcttttgatttcattaaggaataaaacagactcttatagtgtaaataggcatatttgattgccaaacgacttggaacagtgtaactttacagtctgctttattgatttatgagttagacagcagaaacctgcaaaggggaatttatgtggtaattggataatttagtcaaagaagaaaaaaatggagaactaacccagagatttgggttcaaatattaaaacctatctagccatagatgtagactttttattttctttttacacagcccagtagatggtaaacctagtgcatttaattttgaatctgttctaacattgaaaggccacccctatgtgttgctatacagaacttattactctccatttaagaataacttgttagtttcatatgtttaatagtgtgggaaacagtcataaacacaagttgtaggaaatgtaaaatactagaaacttgccacacgtcactgactgtacttggacaacctgtacattattatgtcctcactggctatatgataaagatatagatttctttcatattattttgatgtgtacattttaagactgcaattaaactatagtatgcttttgtaaaaatctatctacaaattctacatataaggatgaaattattaaaattaatggcaaaaactgcaattacttttgcaccagtctaataacttcacgctacagccacagtgaacactattgcaacactctgaatattttgaagtgatccaaatttatcctattatttcccaattttgtcttatgcaaatgaatatttacttcaaagatagcacacagaaaatttatcgatctaaaatgcacagccagataacacttagcataacatactatgttttatttttctttcagcgtttatcgtgattgttaaatcttttatttgctttttaaaaattttccccgtctattcccattctctaaccactaaagttcagctgtaagaccgtgggccacccagcagatttctaacaaatagctggcaaatttattgaattccactgaggtttagtcactaagtatgtgtcagacaaatgtgataggcagtgtaaaatttaaaatgtgaataagcctaacgtggtccttgccatcttgccactcattagatagcaccaaagaaagataaaatttagaaattgctggccacttacgtttaccataatagtgaagaaccatttttccaatggaacttaatagtatcataaagacttcttgtcataatgccttatgattgcccaactttgaagctctgaaaacctttccaaaatactttgaatagtataaaatggaactcttcacatgaaaaggaaagactgatggaaaatatatattttagcctctttatgtattacctagtttttaaggattataccatgtgaatatctaatattttgaaagcattcacgttatttggtaattacagcagcctaatgaagtataaaagttgtgtttaaaagggaatatttgaaaacactagatgaatggttgaggcatgggttgagaacaggatgtgaatgaaaatggacacacaggtttaggggttaataaaaaatgtcctaaagttggattgtggtgatatatacatgactctataaatttcctattgttcattgactatatgtttaaaatgaaaattttatggtatgtaaattgtacctcaaagttgtttttaaaaccctattgaatagagaatatatcaattactattatatatttaaaaagataatttaaggttaccatcaactttttcactccattattttgatgcatagcaaagggtgaaatgtgatgaatgttgttaaataacctggaattaacttaaatggtagatatttattgatggcctactgatgtccgcaagatcttacatagtaatatcataatgttcccattgtttacattctattccatttaatgaattttaatgctaaagcatttttactgaagctgatattttaactcagatctgctttctccactttaataattagccctttattaagtgaaaattaacctagaagtacaatctcccaattatttctaggcagcattccaaaatgttccctagagtttgatttactcatttatctattttgaaaagtaaccataattacttgaaaatacgttatttctattttcaatgtttgtaggcacgtagtagatgtataaacgttacatgagatattttgatacaggcatgcaatgcgtagcaatcaaatcagggtaaatggggtgtctatcaccttaagcatctatcctttgtgatataaaaaattcagttgtactcttttagtttattttaaaatgtagactcaaattacttttttattatggtcatcctgttctagcaaatactaggtcttgctcattatttctaatttttgtacccattaaccatccccacttcctccccaacccctgactacccttcccagcctctagtaaggatccttctactctctatctccatagttcaattatcttaatttttagctcccacaaataactgagaacatgggatgtttgtctttctgtgactggcttatttcacttaacgtaataacgtacaattccatccatgttattgcaaatgacaggacgtcattctttttatggctgaatagtactgtattgtgtataggtaccatattttcttttttttattattatactttaagttttagggtacatgtgcacattgtgcaggttagtcacatatgtatacatgtgccatgctggtgcgctgcacccactaactcgtcatctagcattaggtatatctcccaatgctatccctcccccctccccccaccccacaacagtccccggtgtgtgatgttccccttcctgtgtccatgtgctctcattgttcaattcccacctatgagtgagaacatgcagtgtttggttttttgtccttgagatagtttgctgagaatggtggtttccagcttcatccatgtccctacaaaggacatgaactcatccttttttatggctgcatagtattccaaggtgtatatgtgccacattttctaaatccattgtatcattgtgagacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatgatgagcattttttcatgtgttttttggctgcagaggtacaaggaggaactgataccattccttctgaaactattccaatccatagaaaaagagggaatcctccctaactcattttatgaggccagcatcattctgataccaaagccgggcagagacacaaccaaaaaagagaattttagaccattatccttgatgaacattgatgaaaaaatcctcaataaaatacttgcaaaacgaatccagcagcacatcaaaaagcttatccaccatgatcaagtgggcttcatccttgggatgcaaggctggttcaatatatgcaaatcaataaatgtaatccagcatctaaacagagccaaagacaaaaaccacatgattatctcaatagatgcagaaaaagcctttgacaaaattcaacaacgcttcatgctaaaaattctcaataaattaggtattgatgggacgtatttcaaaataataagagctatctatgacaaacccacagccaatatcatactgaatgggcaaaaaccggaagcattccctttgaaaactggcacaagacagggatgccctctctcaccactcctattcaacatagtgttggaagttctggccagggcaattaggcaggagaaggaaataaagggtgttcaatcaggaaaagaggaagtcaaattgtccctgtttgcagatgacatgattgtatatctagaaaaccatattttctttatccattcgttttttaatggacatttaggttgcttccaaatcttgacttttgtgaacagtgccgcaataaaacacgggagtacagatatttcttcagtgtactgattttctttcttttgggtatatacacagcagtgggattgctggattgtatggtagctctgtttacagttttttgaggaatctcaaaacttgttttccatagtggttgtactagtttacattcctaccagcagtgtatgagggttcccttttctccatatcctcgccaacatttgttattgcttgttttataaataaaaccatttgagttgaagtgagattatatctcactgtggttttgatttactattctgttatgatcagtgatattgagacccttttcatatacccgtttgtcatttatcttctttcaaaaaaaagtctattcagatattttgcccatttttaatcagattattagttttttcctatagagttgtttgagctctttatatattctagttattgatcccttgtcagatgggtagtttggaaatattttctcccattccatgggttgtctcttcactttgtgggttgtatgctttgttgtgaagaagatttttaacttggtgtgttaccatttgtccatttttgctttggttgcctgtgcttgtgtggtatggttcaagaatttcttgcctagaccaatgttctggaggtttctcccaaagttttcttgtggtagtttcataatttgaggtcttagatttaagtatttaatccattttgatttgatttctgtatacggttcaagatagaggtctggttttattctgcatttggatatccaattttcccagcaccatttattgaaggactcctttccccaaagtgtgttcttggcactttgtcaaaaattaggtccctgtagatgtatggatttatctctgtgttctctattctgttctattgggctgtgtgtttgcgcttaagccagtaccatgctgtttcggttactatagctgtgtagtataatttaaagttaggtaaagtgattcctccagtttcattcttttttgcttaggatatatttggctattctgggtctgctgcagttccatataaattttaagattgttttttctatttctgtgaagaatgtctttgttagaaaatacattattataatgaactcttctattatcgttgtcgttattatgactaagcgtaacatcgtttctcaggtatattacaagtaataattatacacaatgtccaattttttatttttaaacggttctgtggtcaagattacgcagaaaaatttatatgctttacttctctgctggagatttttgacccacttttttgtattttcaaaaataaaagtttaacctaaatttgataagaagccacagacactttttcctccagaaatatgttgatataccacaaaactcatatgtcaaggaacaatgtaggggagacactgaaatagactgtttcctttggcctattgcatatttctgataaaagtcaaaacttctttagctgacaaaatttaatttaaaggtaatatttttctaagtaactctacttgggggggggggtttaaaaaaagagtagtacaaagctgtgtgaatttcttctttttttacttgttgaattattataaagtataacctgaaacttttcaacattttttttctatgaaaataattatatttcttgcattttcctatctttggaaagtacatatcatcccaaatcttttgatatattttgtttctttcgttttctaagtacgtgtgatatgtggccatttccctttcttgaaaatagcaatttcaaaattactggctctttcaaaattactaatctaacagtggtacgttcctccatcaatcagtagtctcaacatgaagtattttaatatcttttactaaaatattttcttattttctctaaatttttcctttctttgacaccacagaaactccaataattatttgatatcattttcttcattctgttaagtactttagcctgctgcagtataattttgctggccattttctgttactatatatatgagaatggtttgatgaggtaaagcaagattttaaaaacagccctgctctctgctcagttaactgtaaagtcctatatttaaaatgtgattaatgtttgaatgattttttggttctataattttgccctttaccatattcaatggaaaaatggttaattcgatttcacttgttttattttcctactttgaatatatagtgctgtgaacatagttactgcatgctcaaatgccttttttataatggaatgttgagataagctcaaatgtcttttttaatataatggaaagatgatataatttgctttatattacttgactttgatgaagaaaatctagtgattctgaaaggtactggattgagaacacctcatagagcatatgtgagtgttcacatcagtatccgtgatttgctatgtcctctcactttgtttccattagagtttactgattttatacgaagccaggctgataatttcacaagaatagttgtatgtggttggcttatttgttttcttcaaatgcttactatccatatccccctagatgtatatattaggtgaaaatataactcaaattatacatccctcacatctttaggacaacttagaaatctagtagacaagtagagagatcattttccttcagattgaatcttctatccccaatgttttcttccacaattttattttctttcatcatattctcataatgtcaaaaaagaaaatgattacattgtctttttttatgagtgatttttacataggagattgttcttcccagaagtttcaataatattctgttatttgtacaagttacttttctatttcacaataagcctgcgctaaagtgctaagcattttttacttatgtggttccagaatacagttctgacgaggttaggtaaagtagctggtaaaagatatcctaagtacaagctaaaagttaattacaatttaaatgtaaattttgtggaattaatgtgtaaagatgctggcaaatatgtgtcatgcatgttttacagcttacccatagtagaatcaattggaaatataaagacattttattttataattttagtaatgaattgaattattattaatgaatatgttaagtatatttgatagcctttttccaaatctacttgtatgatgcactctggcaaaaaaaagcaaaaggataacatctacaaagtgttgtatgattcttggatatacacaatatatattaataaatattctgagaagttctgtggtatagacacatgttcatcttcaatttccaaaatatgtttaaccactgagttctttttaatgcataatctactcaatgcataaagaaaattttatctctaatcatattggaacagtactacaaatatgcgaatttcactagaaatgcctatacattatgataaaagtctcacttttatatgatgttcaatgatgatttttttcaatgttaataattttagtggtggcgacctttctaaaaacacagaagctcatcctcaacagtttttctaactatttaatggaaatatgtatatttcaaattccatggaatgctttgccttgagctccaaattgcccaacattcctctcacaggttacttggtccttcatgtcccctgccaacagataaaagtcgagtgtttggttatatgtaagctgttgttgttcctattatttatgacttatgacaacaatatgactcatttgggaaaatgtggaacttatcaggaaggcctgtgttgcagtgatcacttacgctatctttgctttgctttgtaatgctgagcttctagaatttccaggggcagtctttgaaaaaaaaaattataaatagaaaattaaatgctggtttatagaagggtctcttgcaagtgagaggcactgaaacttaaggttctgtagcttcatactaattcctcatctagatagtaattcttactaactcacattcagtctttcctcccattaaattaagcacacacactctgcatgccccaagcctaatctttgctagcttgtttcctacagcctaaaataagatcctatattcttattctctgaccctccaaaaccctttctcagccatatgctagttaaatcatgtaaatttcctaaaaatcaccagattatacagcagatattaatatttatctttctgatcacagagcatgggtttttctgtttttaaaatttttttaaattatactttaagttctagggtacgtgtgcacaacatgcaggtttgttacgtatgtatccatgtgacatgttggtgtgctgcacccattaacttgtcagttacattaggtatatctcctaatgctatccctcccccctccccccaccccacgacaggccctggtgtgtgatgttagtttttctattacattgcatatatttctgctttgtaatttacttatatatctacagtctgcctcttaaaataaggcttctgtaagtataggggcaacaattttgttctcactgtgtggaattgagtagtagaagctgaacgatttgttgaattaaattgactaaatgctatcaacatacgaataagattaaatttctttttttctcacaaatgtccatttggaggatacttttattttaaaatcataattaaagaggcagtataattgttagagggcagcaagtttgttacttcctagttatgttaccttgggcatgttgatgtttctaccttcatttgtacatgaagatgataaatacttatgttaatatgattaggagatggaattaattatataaagtgttagcacataagttcccacaaatatctgtggtggtgaggatactgatgatgatttcttttctttttttttttttttttgtttttttgttttttgctcttctttgaccactctggtataaaaggttaaaggactatgtgtatacttcattttttcctctactaaccttggaggctaaggggatggaaaaacttttaaatacatgtacacagatatgattacagatgtataatttgggccctctaccctctctgagtgtattcttatttttttaaatcagtttcctttcacagtctccacaattgctattgaacttttatcactttgatttaaattccaccttgattctctcctctcatcctcagcagatacctagggttttgtgcttacgaggaaatgacatgttatatcgctgataacttataactaaatatttgtgcaaataacatggacaggtatttttacatatactgtcacatctgatctttttgaccaaaaccaatgtagttgactactgaagaaatgagaatttctcagataagaaaacttcattgctggcttgctattatcattcttgggctagacatgagaaaatcaaggttcagaacatgttgatgctttgcccaaggtggcaagagagagccctgaaatttaaatcctggttactgttaacatgatttcaccctgatactctgagagcaccatgtaggaagcattcaacttcttgcgtcttcacatcttacttttgttttctgaaaaagagccacctctcctcctgttgatattttccgttggccctgagctttgtgcttcactctggttttcttgctttaaacaggtttttttaaaatcaagtttatcttcttacatttaaaaaaaatcactttatgtgttggcttctttcatgtagccttaaagtatgttcaagtctgattgacctgaattttattatgtgtggagacaaaagtctgcaaaagtaatttaaactatttttattagagtgctccttgatccttaatcaggccagcccttgaaaatacgatttctgctctcgtcatccacttctctcttctagctgcaatggtcattgacgagctcatgtaccctgattactattgatcccattgaacctatctcaaactgtcactgttgacctctctctctcattcttaaaattctcacatcaattgatgtgagattttctctcttttctagttcttcttttctttctctttgactgttctttctctttatttggtgcttttctttccatgtcagttaaatttgtgttctccatggttctctctttgttctctctttctgctttcctctaacgcttgaaaacactgaaaaaatacatattatacaaatgtaccctgtttccctctttctctctgtacagacacacatagtgattattaaaatgcaaactcacttcaacatactgctgatttacagtcgcatttcctccctatgaatttccttagttatcggatcaaatattagcaataaaactactgttatctgtgattatgatcaatttcaaattttgaaatttatcttcgtgatcaaaatagtggtaaccattcatttgggacataaagttatttaatacctgatttctacctacatttcttgttaaattttgccaaactccttatgctcttcagtgccctgtctccacaccttgtctctcttcaaccagaaatgcttttgtttttacaactcctatatccttgcgtatccagtatgcatatacagtatttaggactctcatttagaagtaacaaaattgaagtaactaaagcaaaacaaatgagagagaaaggtttttcatatggaaacaggaatgtgtcatagaatccaagggcagtaataaagttttgactcaagaagggactaatgcctgtgttttggttatttatgatagccatttattattcccactaatggttttgcgtgttgagaaagctcacctggatggttctcttttgtggtttcttatgtgattttagtccattgttgtctgatactatagtaacctgaatgctcaactgggctgaacgtccaagatcactcattcacatgcctagcagttgttggctgaaagccttgttgtgattgttgctgaagcacttatccatggcctttcgatgttacttagctttctcagagcataatatgttggatggattctaaaagggagcaccctaagaatgactgttctaaaaagatagacgtggaagctgccaggccacttaaggacttttgccataactggcacttggactatattctattggtcaaagcagtcaaagagtcaacccagatttaaagagctgaagaaataaacttcacctcttgttgagggagtggtaagaggagcatgtgctgtgggagctattattgcagccctctttcgaaaatgctatctacgggctgggcacggtggctcacacctgtaatcccagcactttgggaagccgaggcaggtggatcacctgaggtcaggcattcgagaccatcctgaccaacatggtaaaaccctgtcgctactaaaaaatataaaaattagctgagcatggtggtgggcacctgtaatcgcagctacttggttggctgaggcaggagaatcgcttgaacctgggaggcggaggttgcagtgagccaagatcgtgctattgcgttccagcctgggtgacagagcgagattccatctcaaaacataaataactaactaaataaataaataaagccataccgcattggaagccatcagtgtttttgttaccacctcactccctatgcatctacttctttcttctctctctgttcatggacctttgctcttcctcaatccactctgcaaactagggacttcgtaagcacaatttgctagtatatgtgacacaattcgaagcactcacagtttgaccagactcttctgtcaattctaattttctgagagagattctgatgattctctcttaacacaagcattgtgtgtattctgatcacccataacatggagttggccagaattacgtggcacagacatggttgttactggcccacctttttgaggaggattaacatttccaagatgaaaggccctagccataacccctctaaagcatctgttactcccagcaatgcttactaattattgaaagttctactttaacatcaactcccttatgacatcctccgtacaagcatcactccaccctgcatacttccatccaattttatagattctgtgatgtttcttgctctataaataacgtcatgcacctagatggatccctactcccagattctaggttcacgaaacatatcaatatttctcacacaaggtagttattcaaccaatgaagatcatcgatatggtaataaaataagatacatttatatgcgtatttgctctcatttgttttaaggcagaattctaactatttaggtaattcataattgatttgcctctataattgttaggattaatattctaaggaataatattgaggtacatctgtgaatttataaccttgcataaggagctccttaaccacttagtccatgttcttggtataattctcattactcagttcagggctatagttcgctctggaaactgctaagcaaaactgatgttatcttctaatgatatgtatcagaatttactccaattggtgtaaattcacttacactaatatacgttatgcaaaatgatctgcatgataatgttatgggcactctggtataatttagtttctgctctaaattataataatctaataatgactgaattttaaattagaatgatttgaccgctagctgattttgtatggatttgacagaaataaataaataaatgtattgtgttcgtgtccacatgctgcagagatccctgcctataactggctcagaaattcatatgttaaatgcagaatatactttactatagaacttgatcgaaaatgtctttattgaatatataaatattgaaatgttttatagttatctaaaattcacaatcagtatctgccggaagccatcaaatatctatcagacaaatagcaatacctgtttggggcatttgacttccatttcttagattcatagcttccctgaaatttaactgaaatatggcacataatgactgagtagactacactaaggccaggcacagtggctcacgcctataatcacagctctgtgggaggctgagacaggagaattgcttaagaccaggagtttgggaccaggctgggtcacatagcaagactctgcctctacaaaataaaataaaataaaataaaaagaaggtaattaaggagtattttccacatgcaattttctcattatatctcatccctgtcacagttggctgaatcttacagattaacatcatgtctttggtccgatttgagtgtgacttcaaagataaaacatatcaattctacatataatatataaattacctattgaaaatgatatctgaaatagttgatattgactcaaaatgattattgcttttttcataataatcccatagggaagaaataaatcgtttcacttggataatttatgaaagtaaaaaatatttatgataattctatttaggtgatccacctgcctcgacctcccaaagtgctaggattacaggtgtgaaccaccactcttggccaatttacggtcattttaaaggaagctacatggtagaggtggttgaggagagtttctgaatttcgtcttcttggaaagttagttgttctttgtagagcatgctgactaataatgctatcctcccaacagaaaatccaatctgatttgacaagtcatgagatcagtttagaagaaatgaagaaacataatcaggggaaggaggctgcccaaagagtcctgtctcagattgatgttgcacaggtatatgttatttcagaaactaaggaacgtgttttcgttgggcattatactccagtctatattggacaacttgattattggcaagattggatttgaggacattatttgaaaactataatttgatgtctaaacaatgagtgttttgctctctacattttaaagataaaataggttaataaattaccttttatttagtataacattaagaaaaaactactgaatcattctcccaaatgtatgttttcctgtgttggatgaatggaaaaatactgctttattttgtttttatttttctgtatatcttcagaaataaaggcagatctatcaataaaaataggaccagttattgtttgaaaggcaaaattaaatcagtgcctttttacactgtccttacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtggtatgtatttctggtggcaaatacgcaggtaccccttgactttcctcattaagaagtaactgctcttttataagagagaattgttttcagataaccataataattatactatgtaattttaagattgagaacaaaaattggcacatgtattgtggcctattctgtgtgtcttttttgagtctataattctgctaagaactgtgcagaatataaaaggatgttgcttgtgtttaatttttatgattctttaaatatattttaaatggaaatctagaaaggaaatatattaatctaaaaatagtaacaacaacagtagttgcaataatcctaacaacttcagaaataatggatgccaggtaaactacgtgacatacagaagtcacctttaattcttaaggctacagattacctgagagaatttaaggacaaacagctggtgaatggcaaagcaagattccaattcaggtactcttattccaaactttaataactttcctttaaacaccagtactggatatacagtgaaatgcctcaagacaacaccgaattaaaaggcatggaaaggtacaaatagcctaaagtataaatctgatttaaactttataatattgaacggtgtcctatgttgctgttattggaaactcaccaactgagatgattcctctgaaaacaaagctgaggtatgattgcatctactcgagtaacataagtattattataactctacatgtactatcggccattagagtgggaagtcacataaaatgaaaacacagaatgttattaaagggaaaacaagtctatttagtacttgatattttaagtattgtttctacatctactccataatatcaatgaaaaacagagtccttcagatacatcgtagtcatatcatgaatggggaaatatttttctttttaacaaatatcttaaaataaatacatatatttatgtgtgaaaaatatgaggtattcttattcgataatatattttcataattcaagctgcattttagtggtataattactttaattattctcacccccaaaaagaaacttggaatagaaatgatagaaagtagttagttgatattagatgagtaaggataggaatatatgggaacatatcccatcttaaattttgccaaaaaaaaaaaaaaggaaagcataaatgacccaagtgccttattcatgactaatatttgcaaagtgagcacttttcgttcttttctagaaacaggtctctaatgttaccttataaaatgtatccaacagtaaatatgagctgaaaacaatctcacctgtgtcaagctgtgactgtgccctgcgtcagtacaaaggaaactgctcaaggcatttgctcaattggtttctggttctggtttaaatgtcaggaccaattgaagcagttctttcataagaatatccttacactgtttagttttttcattgtttacgatgctttgtggtgtataccataatcatagtcttgccttcaagacatgtttgtctatttataaaagtcttactttcatgaacacaaatataaataatatttctcccctttgtttataaatattttacttgcctattgaatgaaacaatgttaatggctaacggtaccttgagggaactttcttcatcaaaataaagcatttatattttttgaagttcagagagtaaataatttagaaaaatctctgattccaaattagcatcgttgatttccaacataataattaatttcagtgtttccagatacacagatatttttatatcttctaagaaaaaagtaaaatgaagtaaataatatcatctgggaaactcagacaaaagtcataattattagtgatgaaggaatgttaacatcatttgtcaaagaggattaatatggaaatatacatgtagcattgatcagataattgtccagcctttacaaaatgcttttttttagacattacttttaaactgaaaagagaaattaaacccaatttttgttctaattccataaaaacaattacctactgtcaggtttattttttggtaatactaaaataagtactgatagttcagatttatgactaaacaaattaaagcagagatacataatgtaaactattatatatacgtgtatacgtatatacacacacgtacatatatttgaatacatggccacatacatacaaagacatatatttctaggaaaactacaaagcaaaattaagacatcaagtggtgttggagtggtgttggtggtataattgtgaacatagctgtcttccaaagttatgacacttgtcttatgatgcttttttatagcaacctatgttttgtgaaaccgtatgtgtgtgctttatatttgtgatgtacatgtgaattgtcaataatatttttatatctggttttcatcagcacttttaagaaaataaagttgtgtaatttaattaacattgaaaaggaccttactttcttatatatgatacaatatatattgaaattatgatgtagaaatttaggtgctttaatgttactaatatgtaagtaccatgagaacaatagtgaatgtgtgtgttttggccaccactgacttcccagtgattcaaatactatctgattgatagtaaccactcaataaatacccgatgtaggagtgaattaattcatccaaatttatggctagaattatataactccaacatttaaaatagaagtcatgtaaaattcagaattgacatttatgttctttgattgaagaactaaatatatatatatcacaaaacacatatatatgattaactctctgtttaataagaatagctgcaaatgacacatatatgcatgtgtgtagacaattagaaatattaaatcaacagaaaatgcaaaagctagatattgaccaccgctgcaaaatgctactctattaaaatttcaaacatggaatagcaattaaggggatctctatttatttctgttcataatattatgaaataatttaactctactgattatcatgttttgttttatgtttaaacttagaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtgtgtgcatgctgagaccacaaacacttctttccactttccttataaattgtaaagcaacgggcaataaattatgtatgattagagtcttagcaattctaaacacctctctctctctatgtatatgtatacgtatatatatacacacatatacgtatatatatatatgtacacatatacacaaagataaacatatacacatatttcgatgtggaattctcattaagaaacaataattaatcagtgaggctctgcttattcagattgaaaaatacgtaacgctcagggaggtttttcctggtccatcagatagctctaaaagggtttcttagttgtaagtgttccttattttcattatatatatctacttgtgatgacttgaagactggtaaatattataaactgtatctatttatatgtaggtctaatgttgttaacatattccacagagaccacattaagtttaaaaattacacagtaattatttccctatatggccaagacttgcaaaatctaccacacttggctaataagatagcatggatagccagttaagacctacgtctctgtaattatttttgtatcattgtcctgatcagagtctcatgaccagctccacttcactgctaattcaagatgcctatatctctccatctcacttcgctcaactcaaatattctgtatagattatgatagtaagtagtctcttcactctgttgattgtttgttttgctgagcagaagctttttaggttgatgcgataacagtcgtctagttttcctcttgttgcctgtgctttgggagtcagatccaaaaaaaatgtttgcccagaacaatgtcaggaagctttttcctgttttcttcaaatcattttataggttcaggttttaagtcttgagtccattttgaactggttttttatatgctgtgagataagtgtccaattgcattttcatgcatttggatatccaatttctcagaaccatttattgaagagaatgtccttttttcattgtgtattctcggccccttggttgatcagttgatcataaatatgtggatttattattgggctctctattctgttcctttggtctatatgtctgtttttatactaccatcctgctcttttaattactagagcattatagaatatttttgaatcaggtaattatgatacctccagcttcgttcttttggcttaagattgctttggctattctgggtcttttgttgttcaaaatgaaatttgggattctttcttctacatctgccaaaaatgtcactggaattttaatagggattgcattaagtctgtaaattgctttgagtggtacagacatcttaacaatattatttattccaatccatgaatatgggatatctttccataaacggatatcttagtatttccaaaaatggacttctaacattttaatttcgttctgactgaaagaactgaatttcttggaggataaaaagttatatttttacaactcaggttctcaactttagtgaatagaacaacatcactgataaaattgtcacctcatcttagacagaaatatgaatgtccatgtttgagaaatagctaaggagaggcatatttcttgcatctcagcctgaaagtagattgaaggttatatcttcaagatattagttgccaattccttaccatagaaagtaaattttataattaagttgaaatctggaagtaatcatttttcttagatagtcttgtttttatattttaaaaaccctctaattaatatttgttatgttttaaacaagtttgttgccatcctatgacaaaagattctcctactttgtttcaaaataagaaacactgatactcaattgatgggaaagcattatgataatcttgaaataaaatacatttcaactgttcatttggtctaccaaggtacctttggaatgagatacctttatatcctctagagaaatttatcattgtttaaagatcaccacagacagaaaaattgtatctgcacttgataccttattccggtgcttatcaatttttatagatgccaattatttcatatttaacatcaattacgaaggactgagtaatctctagtctcaaatgtattagagattgaataatctctaatattaatcctaatgctacagcttcagttctggagatatattgtttttgtaattataaattttaaattaataaaatgaatgtatgttatagttataaattacaaattttcagtttataatttgacctgtgtgactttatactaaaataatgtatggatgagtattttttaaattaagaaaatatatgttttggtaaaggggagtttctcagtttactttttaaaatagaggttttttgtgtgtgggctttttatttgtcataggaatttttacgaaatcattgcaagagtaaatttaacataaaataacagaataaatcaattagaatttaaagcaatgaaagtgacattagacgaataatagtgccctgagttgattattattcagaaatgaatgattctcgtaatgatgtcaaaccctatttattcctgaaaatacatatctgagagcttgtgtttattctaaccatttgccacatagtaatatccttaaagcaaaataaaagtgtatgaagaaatcatatttaactttaatagtatcacagaatacagcaaaaacataggccaaacatttatttttgaagtaaatattgatgtagaaacatttgtgactaagggatcatgtataaataccatcttataaaaatgctgtaagtcctatattctttgcctgagaataaaaatattgtctggattttgactcaaaatattttcaacagcagtagctttgtctaatgaaagcaaaggcaacaaaggaaatgttattacattattctttttatgtaagaaggaacccttctattttaaccatcttcagaatttatatggttgtgtctgccacaattgagtatgcattacctttttggagtaatcagctctggctgccataacacaataaaataaactaggtaaattgatttctgcaagtgtggagtctgggagtgcaagatcaaggtgctgatccatttcattcctgaggagagctttcttcttgtcttacctttttgctgtattcttacatggtgatgagtggggagagaaaatataattaatttattaagagatattaaagctggcaccattgatgtaataatacctataacccctttttatttctctatgctctgatttttatggaaatttacataaatagcaatactaatatcatcccttaaatacattgttaacttcgtgaaacaatgactactaaaacattttactgcaggtggcattgtgttaaacgtatccattcctcgcatacacacacaaagtataaaactcaattttccttaagatggcagtgtctcctgttttttaaaaatgtatttagctggaaataaacaaaatgaaataaataaaaatcaatactgcattagctctgggaagatagaatttctttgaaatattgaatctggaatcatttttctaccaataatgcataggaaaaatatgcatagaaacacaccataaagtatattttccctcaccccccacacacccctacaacacaaaattcttgcagtcaaaagggcagatgcttttacttaggaaaaaaaaaaatagaagggaaaatctgtttaaaaaatgaatttacagcctcagcaactaaatgttttctaaatgtacgcacacctctcctaaagaaaataaggaattttattatttggaattggaattgttatcaaggttccagaatatttatttcgattgtagcattttagatgctttatacatatttttatcttttgtgtttttcttgcttatagatagattcttattttggttgtacacacacatacacatagacacacacacacatatatatgacataaatatatgtatcagtcagtggtgcctattgggcttagggcataatgcacaaataacgcacttgtggtggtggtattgttttaaccaattccattacaattgaaattaatctggagtctacctttcagatttcttagcaacaaaagccaaatcttgtccatgttttatttacctgtaaggtagtaaaataaatgtaaataaagcttttgctctatacattcaggcacagttttttattgaaccatccctaaaggtaaataatgagaataaaggaagggattgaggtggtacaatatgtcatgctctctcaaactgttgtctgcctttaccctcgcaatattcctgtgttctattaataagtatagtaatcccatttgacagatgtgttgagaaaaatgaggtgttctgccaaaaatcatactcaagtcgagagtccactacgtatcgcagagcctaacatacttacattccatcatgctgtttctgcagagccaaatatttatatctattgttcagattcccaggcttcatgacagacaagggttttttttaaaaaaaggtgaaaacacataccaaagaaaagaaaaccaggagcaacttgtaagagtataaactctttatgtaaattctaccagttatattttctaacttgtaattaacgatttgcaagtcttcattcattcctttattcaatacataaagcatatttagtgagacctttctttgttcaaggaactttcaggagtagagaggagtaatctaaagatgtgtgaggcaagaagatttgcctttaagaaattgtaatttatctggcttttgttgatgatttgactgcctttagtagaaagagatgctgggatttttattaaaccaaccaactgaaaatcttaacaaaatataggcacatctgagaaggtggtggagaaatacagatttgttcatttcttatgtgagaatatggataatttgcttttgagggtgttggtatcaaacactgagaacaggagcacaggatcaagtaattagtttttctattaatgggaatgaatattgtcttcacattcatctttttgtccctattggatggcaaaattatgtttaaggaggaagtgacctattcactgtattgtttttgagcagatgtgagacactttaaagatgtaacgaggatacagttgagaattctaggtattacacaaatacttttaccttttgagagaattaatcttctatcttcattttgattccttaccagcatgagctagtctcacttgtatatagaggattgtaaaccttcttgccatattattgacacatgacagtaagttttcagtgagaaatgagttttatcttcagtttgacttatatcattgtatttatcataaactttggctataaattatcttagagaaaaattcgtataggtttcttttctaccatgacgacatacaagaccctatcttttggacaaacgatgtcatctgccctagacagtttttattcactcttaatattcagaatatatgatttttataaaatattattttaaaacgtgtaagaaaatagttattttaaataacagaaatataaaagttccaaataagtggttataacgaaatttgaattaaagagtaaactaaattacatttcattataattcttttcaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggtaaaacctatatcactgaaggttattttgaacatacgtgaaaacacataatatgattttgtaaggaagtattaacatgtagcaataatagcattataaatattaatattgtttcatattccctttcttaaaaattaatctgtgcttttcaggaccatgataaaaccaatggtaagctttagcaggagtctctccaaaagcttccttagagttcagtaaattatgaataagaccttaagaaatacataggtcattagtctgaaaattggtccagagatgagatcctataatgtactggcttgcctaagaccatactgcccagatgaatcccacagccatgaagagggcaaggacacagagattgaagacagttgggctggacaggacttgcaagattagcatattgccaaagtcgcatttcagaaagaatctcaaggtgtctatgcaggggctatcatttccatcaccaaatgacacagcgactcctgtaatcattagccgttaaattcttgccctttctctgatggccaatcatttcatgctgcttagaacttagtcaagagactcatagcttagtatttttttttttactgtttattcattaccagattacctgaaagtgtgttgatataaagaaaatagctgatattgataacatgttttacctcaaaatttgccactgtgttaggccatttacacccacttaatgttttaaagttaccaaattaactagatgtataagacgtttatactttatttttaattcaatgtggctatccagattattcaaagttgggaaattttcaataccttatgtaaaaacttacaatcgtataaatgagacccaaactgaaaactgtctttatgtagattcagagaacaagtagtaatatattttgttacataaaatatttccaaataaatagtagggaattaaattgtttttcttctctttcagaataaatgtaatgttagataagatattgaattatagttattcaggatcatacatgagattactatagcaaggaagatacagtatatacaggttaaaactcacattagccttattttttcttatcattcaaacatattacttgaggtatttttgcattagcctcaccatgaaatcattcaaatgttataaggtaatgacctttgcagaggtttctaggttatccttctcatatagaaggcttgaatagtctggagaattgtctgcttgttgaatctgcctggaaagtatttttcataacgtcaaggagcaaagctactgtgagatctagtaggaaaaaaaaaaagcttagaaaactggcatttattttctttctttatagaataaagataatttatcactctatctagatcttttcaaacactaagctgttaatgacatactctaaaatctcttagttgtcaaataaagtatattcatttgcatctgaattacagaacttttttttttttttaccaatttatttggaaggttctcattatttctttaaaaataacaatcataaaagaatatatgccctgcagatctaagccagtcacatttatgataatcattctaatattttaacataaaattcaaactctcatatatgaaaccccgtgactattgagtacattctcatttctcatggtttcttggtaggtggagagcttaattcaagctataagtttcatctgctgtttcaaaagataaatgtcacatttttaaaaactaaattaaattcatttaaatgcaatacattaaatgtagttgccgatcattccaagtatttggaatgtgactgcagcaaatttgaatatctagagtcaatttcttttttattattttaaaaaatttttagacaatttaatttatatctgctgaatttctcccagttctgttgacccaagaacattatatttattttcgtatgaaagtatttgaacatctagtttcaaatattcaaatacataaaaatgtcaattactcatgaagtgattttttgacctttagtttatccaaacaaagcataatttcaagtacattgactatagttaaatagtatcagttttatcttaaagtatcttaattatatttaatatatattaaattccagaaaaattatttagtgtggcttgaagagatacatatggcacaacttgagaagcctaaataaattggaaaactaggaaaaggaaaattatagtagataaataataaaaaattcttgcatagaaatatatccacaatgtatcatgggtggtggaatggacagggaacattttaaagccacaaattggcgccaagcttcctaaaagacaaaaccaagaagtaaacatatttttgagacccaaagtttccaaattattaaaataataattaaaataattttaactttactagtagtatgttagctttttgctagaacttagtgccagaagaaaataaatgggagggtcataaaggtgataacacgctgattcatattcttataataaacaataagaatgtttatttttttctaccaacatggctccatgaaaaagaaaaatttagtgctaaagggccattcaggaaaagcaattctatgagaggaaaaaatattggagcagaagtctaaagtagtctagcaattgttttcagattttcagattctctattttattaatttttaattttgtatggatacatactgggtgtatatatttatgaattataggagacatttttatacaggcatgcaatacgtaattgtcacatcatgtaaccttctgtgaatatgctttcctgcaactgagcttttaagtagaattagacatcagagatttgaaggttatttattttctctgaatacagaaaaaaattttctgtatctttttcctggaaagaagccagattgtttctaactgagaacacatttctatacttggccctatatctaattggaaagcagggcttcatattcatgtgtatgtcatagtactagaaggcttcaatagctaaaaatttttgctaacatagagttttgggtttgaaccagtcacagagaaattggctattgagccttttcgtgccaagcataattgaagaaagaaaactcaccatcgacaactcaaaatatgttgacttctctaggaacctgtatcaatctctcagtgaatgtatttatttgaaaacacagttgggctattactttagctgtaaaagctattgaaaataaagctcagtagtactctcttacttgatgatggcatttaaaaggtgaagtgagaatgttttatagggggcatgaagtatcaagtactgagtgtgatgaaaattaatatactggttaatgataatactgagtctaaatgtactagtttttcctgtgatatgagaaaactagaattcacttttcaagatcaaaattagcaaagaatttggaagtattgctccaattggagaatcagaagtcaccttaaaaacaatacagattttactaatctatagtaatatatatttcataaagtcttcatgtgacacaaaagttttagggttttggtttttaactagccgtgttatataatcgaggaaatttcctatcctaaattagaaaagtataagcatatttaaagttcaattcagtttttcttacattacgaagctgagaaaaatgaatctaacattaaaatcaaaagcaatctggtctggcttactgtattcatgtcaccaatgcggtttatcaaaaatccctgtcatatcaaatcaagcccttccacaatgatctaacacttaagtttttatgagaaaaaaaaaaaattggattctctatactcatttcacctccttaccgtggctgtgggcaggccccagatgatgcattgtctataatataaactatgttggtgaccaccaaagcagccaggcattcttgctgttccttcatttcttactagattatgttatttaattaatttaatagtatttcatcgcctatttatagggccatagtccatgtgcaagcagttttccagtaccaccaaaattctcaataaggtcccatcacaactatcatttaggcctaccataaaatacacagaattaataaaatgagacaaccatcattgtgtgagcaatacttaagtcagccccatgcaccttcagagaggtactactagcattgagatgaattattccaacttgtagggaaaccaaatagataccgaaagaaagagtttattcttatttatttattttgagatggagtcttgctcttgtcaccgatcctggagtgcaatggcccgatctcggctcactgcaacctcctgggttcaagcagttctcctgccccagcctcccgggtagctgggattacagacacctgccaccataccctgctaattttttgtgttttcggtagagttggagtttcaccatgatggtcaggctggtctcgaactcctgacctcaggtcatccacctgcctcggcctcccaaagtgctgggattacaggtgtgagtcaccacacccggccagaagagtttcttacactggccaaaagatcagttatgttctttataaacttggcataggcttagggggcaattcaccatttgttttctaatgctgtgccctttaaaaaggaaggggaaggttgcctaaaacgatgaaagagatgttataaaaatcaagcttcttgagaaatatagtaaaattggaaacaccttaaatgttgcagtgtgttaccatttacacaaaggataaaatatgtagaaatatacattatttagttatatataatatatagtaaaagcagaaagatgtttgggaattaatataaactgaatacagaacaagagctatctctgtgaggaaagacaaaagaattgggtgggatatgaacaggacacttaaatgatacttgtaatatttcattccttaagatgagttatgcatacagaagtaatgattacatttggtatactttctgtgtgtctaaaatcacatataagaacataagaaaacatacaaaagcaaatgcttgggatttttccttttggaaactccactagccaggttctgtaagataacgcttagtaattaaggaacacccacttcgtgagtattattggtttcaaaagagcatggccactgttcattcggtttgcctaagcattggccaaagattctcctgctgattgagcaacaggacaggaacctagcagattaattccagcgagatgaataaggaacattgtctttccagtttttaaagaggatgtttctgtggctttttttttctttattatctacattgaagcatgatcgacagattcttatcaatgatttccttgtgaaagcagagtcaagggaatgaatagcgcaaaccgagaactgagaattttcatcaaagtggaaccaaaagttagcctgtgtatggtcagtttgtgtggcagcagtgctgttctatccttaagaacacttctattcagagagaatcgttattagagaggacagatctgtaagtcactgggtgaggtaacatcagaactgaaggtcctctgaaaatgatcttatttccctttttgtaaacaagaaaactgtgcaaaaagctccatatccctttctctgtttctcgattactttctttttaaaattactttagattcaggggttacatgtgcaagtttgttacatgggtgtattgtgtaacaattctaaaattcatatggaaccaagaaagggcctgaacagctaaagcaatcctaagccaaaagaacaaagttgagggcattacattgccccacttaaaatatactacaaagctgtagtaacgcaaacagcataatactattacagatatagacacctagatcaatggaacagaatagagaactcagaaataaagctgcacacctacaaccaactgatttttgacaaagttggcaaaaataagcaacagagaagggacaccttattcattaaatattgctaggatagctggctagccatatatagaggaatgaacctggacccctacctttcaccatatacaaaaattaactcaagatggattaaagtcttaaatgtaagccctgaaactactaaaaatcctagaataaaacctaggaaaagttcttctggacactggcttaggcaaagaatttatgaccaagacctcaatgacaaatgcaacaaaaacaaaaattgacaaatgagagttaattaaattaaagcttctgtacagaaaaagaaacaatcaacacagtaaacagataacctcctgaatgggagaaaatatttgcaaactttgcatctgacaaaagaataatatccagaatctataaggaacttaaacttgtcaacaagaaattaaaaaaaaacagattaaaaacaggacaaagaacgtgaatagacactcctcgaaagaagacatacaagcggccaatgagcatattaaaaaatcttcaatatcactaatcatcagagagatgccaattaaaccctaaataagataccatctcacaccagtctgaatggcttttgttaaaaagtcagaaaataacggatgttgattgctttcatagggtgaccatgattacatttgtaatagtcattcactcctaaggatttcaaagtcatgtgggtccaggatcctcaatatgaggattaatgttaccatgggaaccatgaaaagagctgacctaataggggccatatcaattctagccaacttcttgagcttcctaatagagaagaatgcctaagagactctctcaccaagaggaaggcaaattaactagtcagataaatgagagcagagatgggcaaactataattggtaggcctaatccattcagccaccttcttttgtacagcccatgggctgaaaattgtttttatgtaaatggttggaaaaaatcaaaagaagaactagatacttcaggacacataaaaattattaaaaatgcatatgtcagtgtctgtacataagactattgaagtgtatcaatttatatttgtttattttttctggctgcttttgtgctaaaacagcagagttgagtaattgtgacagagactgcatggctcacaaagcctagaacaactactatgtggccattcacagaacatattcaaactcctgaactagaggaaagctaatatagaagcagcaccctgtttgaccatagaattttgccatgtcttcttcttgaatgagtatcagaggtttgacatttctgggatccttttgataggccagtggcgttgtagaattggtctttcctaaatagaatgattcatctaagttttcttcctgctcagaattaaatagtaacatattccaaaccatagatactagaatgcatagcccttccaaaagatactgggtggtgcgtgacacaatttaagatgtttaaagataccatctacttgaagagaattacgaactcaagaatgtcttaggtattctaattcttaatgatcccacagagaaagaatgggagaacttccagaagtagtgaggatgtggtcaggggtgattaactgaagggacagctgcaggtaagaaaactgtcctgtgtccccttaccctgtgaccatgtttccaaattatagttacagaaaaaaagaatatattttaaaagtattccaaattgtttaaaaggtaaagaaaaatttttaaattaaaatgacaggaggaaagccatttgagaatattaacaaatgagataaaagattgatgatgaaaattgacaatttaaattattaatgctaattgcaacttcctacagcgacatagccctttcactgtatttttaaattcacccttcaatcagagtagtattaaagagggtaaaattaatgttaagtttttaaaaatatggatcaatcctagctagctgcatggtccagacaacagcaatgccacgaggcagccatcacagtgatatttatcaccccataaatgttcagatacttttccttttctgttaatggaattttctaggctgaggtgacaaacactgatagctgtagaatagagatgatggaaggaaatggcaaggcaatctacaggagattactagcacctgaagagtttgaatactggaactgcacaagttccttgagctttcatgataacccctactctcttggactgttatgtaggcaatagtaattcattcagcaaaaggacagggaaaatgtgtattttggtctctgatatttcccatgtacataagatattgcctgacacataggacatactcatgaaatatctgtttaaacgtaacttgcaaattaagagttgcaaattataatgacaaagcagttcttgagagaagagaaaaatgctgatttacatttaaaattgtacaagttttataacaaacataaataatcacctgatcaaatgttcccgttttatagatgaacaaatacaagtcctggtacatagcaaaactgtaatactatgcctgatttcaacagttttttccactataccaaattatcataagaagtcttattttctagtaattttaaagtaatctaagcttaaaataacaaaaagctacttattcacaataagcatgaaacaaaccatggctaaatttcaagtgcagaaaatataagtcctcattaaaataataaaatgaaaacccgtgtgtatctatcacctactacagtctgtagtctgtccccactgttgtgattttagatttcaaatattgtttgttagtatcttaatatcactctgattagttgagtgtaagtaaatcaatctgaacatcccattactggccaatattgtttagcatatgaattgatcacgaaaacataaccataggaaagtaaatatgtatgtgattaattagaggtttacttccctgaagatcattatgtttgggaaatacaagctttgacaaagtctaatctatatgattttctgatttaatcactaacattttatttctaattttgttttaagcatcaaagattccaactcagttaaataatttagttccattaaacccctaaatatccatggtgtcatctgaaagttcaaatggtagaataagattttctggaaaaaaaaaatttggtcctatagtatgttcatcctaccgcctgttttattaacagtagtcttagtatgccaagagttgcctgagaggaacacacacaaacacacacgcacacaaatggtattaataaatttaactgaaggtgttaaatgcagaataatctatgtctaaatagccacttgtttaacaaattaccgtgtttttcacgtttattttggaaacaaagttttataatatttaacctcaggaagaacaaacattggttgctcaattatcctttggctttcagttcactcttagaatttaatgactatcactcaataaaaactcagaatgcatctttctgtttgcctgtggttttcaacattggttgcacatcaaaatcacccgagaaacttgaaaagtatcccaatgtttggggcccacttccagagattctgatttaattggtctaactctaactagctctcttattcagcaaagttgagaatcactagataatgtgatacaagatccgcgaatttcaagctgtctgacgagagcctaaattcagctcagtcaaccatgtcttgtatatatattttttataacagtaagatttcacagtttaaagagatctggtttctggtcctagattatctggataactgcctcaactcatcattcctcttagctataaaaatataagaactattacttactctaaagtctgttatactctcattcccctgaaaaattacgtatcttttttttttaaagtgagcagagtaatttatctgtgaagtgaaataacactagcagatcattaacttggtgcaatgaatgcatcaagcagctgttacttagaaaatagaacatctgttacatgccattggagtcactattcactgtcattatagttagagctgttatttctgttcagttcattctgctttcatgaaattcttctttaataaacaatacagtgttattaaaaagtcaatacacattgctatagaatccactatttaatgctttatgttctttttgaatgtatcattatattattctgtcacattagcctaatagtaaaatatgtcctaaacctctagccatgatagagtaattttgggggctgtaaaagcaattagcatctcatttcctcatgtttaagacatgttagattgtgtgatgcaccattgatatgattacagctgctgagaatttaaaaaaaaaaaaaaaaacactaccactttcaaggtaaaccttaattgtatgttacatctcaatttccgaatccttaaaatgtgacaaatgcacatcttagaattgcagtaatatggcaatgtattccttttctttccacgaatatgttacgtagctaaaaggtgaaagaaccctctcctgttctctgtgatcagaaatggtataatatttgcaaatactaagtgcagaattcacctgggtagggggacttctcaagatgccttttatggatgctttagttagccttttattcatattacagggaacatgagtaagagaaaggaatagctaaaataagtctgaatttaattgagtcctagtaaagggaggaatctataaggaaatgatgttaaggtacgtaggtaaataaatgtggtgctgattgaagataagctctagagaacaggagactcttaagataataaaatttgtttaaaaagagggggtggaaaaaagagatcagacagagaagttatcttaagaatataagtccctgagaaattccaagaaaatctgtggaaggtactggaaaacttgtgaaaatacgaaatgggtggaggagagaatagaggttaagtgagctacatttctttacccctgaagggaaatgtttgtaaaggtgttcctataggaccagatgatttttccaataatttttaccgttctaccattaaataaaaataatgaaaaatgctgatggtataatcagcagagaccaatggagaaggtttttccatcttgctactgtatcagtgaagtgagccgatagctgaaccctgaaccgaacatgcctttttaaatttctacaagcaattatacttgtagatatggggaatgaatcagaatgtattcttcatccttcccatcaacatggggcatgacttcactggaagaaattaactcattatactcattcttttataataaggaaattagagtagcatttacaaattatggctaagaagtagacagcaaatttgtttgaaatcatggaagttagtgcttagtatttggactatttatactggagctatcaaatgttacaaagtaacatatggaaaataatatgttagacattgtgagaatttatagtttaattggattttacttatgtcagatattttcccctctatcataaaaacccttagtgccaagtatatagtttgcgttcaccttctcttgaatctcctgaaggtggacttacaatcatgtcataggtcaagttaaaactgagtgtacacaatcttgctttttcttcagccctaaaatcgatcctagcagcaatcacattactacatgactgaaaaacctaaagtgtctgagttataatttagtgaatttagtcattgaatttgaacttgctccttcagaagagtagatcttctagaaccctctccacttctcacctcacaaggcagaagaaggcatgtatgctgagaatcggatgcttttgaaaaggaggaaatgccatatcttttcagctgtttctttccatctcgccaaccctataaataaggagctccctttgagaggaatgagtacaggtataaagacaatggccaaggcaatagctctaggttggttctccatacatctgaagatgcagacattcttgtgttgtgggaaactattagagccagagaaaatggttcgtcaacaacctcatcaaatgtattcttttagtttacagtaagaattccctgttcctctatggcagccttgtattctaactttcataccttctcgttgcttcgtactttgtctttagtcaatccaaaccatcccatgcacactccgccttcaagtgtcacctttcccttgtagtcattcatgcttattccagccatggctcatctgtttccaaaaaaaaatgtgatttttttctagtatgatatcaaattgttttattgcatttaagctttcctctgcagctacactgtaggcatgattagagtgaggtttgcaaagattacctcattcctcatctctggcagtgaatagcacagtacagactggatattaggcacctgatatacattggtcaattagtatttcagatctccagaaagcaagctcagcatagtatttaaaggctaagtcttatttaagtcttatttcttaagtcatatctttgattaaaaacacatttgagggaaaaatttaaggcctactaaattaacacaatattttttcctaacccaaaacagcatgtatacaaatgattgaatactggttccttattgttgaatagcatacataaaagtttaactctaggtctctttttttacagagtgtaaattgtcctgtgaatcacttttgaccattagcagttataaaccaccatcatatcactgcttttttcaaatacaagttgataatggtgataaattgaacatcttttagttttaatttataattttgtggaacttaagaaggcactagaaattagtccacatttcctattttgttcccatcaactgaacatcactggacattgtttaaattagctggaggaatttggccagatgttgacacataatggtttctgtgacccaggaactacctgcaacattatcccctaagttcaaaacttttgtgatctcttctgagttttggaaaattccattgcctttaattgcattgcttgtcatgtaagaaacaaaatctatgtacacaataactttttacattgatgctaaaatatagtgtcatctttatgaagacttattaagagataattagtaatccaaatataaattaagcttcaactttgtgaagggttacctttgtgaataaatcaactacagcgagatgccagtagactggaatatagaaagtagataattctcatttgcgtatatgtccatctctttgacaaactcatacttggatataagtttttgaaggatggggacttctctaccgttttatcccacagagcctagtaacaatggctaacatctatggttgtagaggttgtatactacaaaaggttgaagtcaaagtattaaaaggaataaaatctagtctatgtctactctgaagttaagctctaaagggtctgtatctacccaaatgagagacttctaataatctcccagaatatattgaggagaattacatatgattctgctacagtagtaactggcatataataggagctcaggcaacacttacgattgataaatgaagaaattgcttttatgaattgctaagctcacctgtgtgcaacaaatagcacctacatatgaagaaccccatgcatgatagctgtcgagttcatctggcattaagtaccttaatttcaggcatgtttttattgaaaaaatgtgacataaaaccatatcttagaattgaagaaacagtgtttttgtcttgcataaaaatttttatacattgtttcctcatttatttctcctgtttatccgatgccaaaggcaaaaccaaaacagaaagtatgagaagtgatttcgagtggaccaggaccttatggcgtggcagaaagacagccacaggactacttaggtatattataaagatagaaaagacatgttgagagtgactctatgaggccagcctatacctaatttcttactcttgtactgtaatttttttcttaagaaattagatgtaggctggcattacagagctgctccttgtgtgtttattaattgattatttgtatctggactttctccactttcctgttattgctgtttctcaatgattttgttttgctttggctttctgtgattaagacatcagctccactcgcaaatagcttttcaactcgagtgccaatcacagtctctgtatctgttaaccttattgagaaaggagaaaaagggtctgttgggctctggctcagctctctgtgaatgtcccacagctggctaactagacaggcagggaaagaaccaggcacagactcagtggaatgccgagtggccacattgtctgtcagccgtgccatgtaccaggaaaggggctttatgcagggcaggtagtaaacctttgtactaagatcactttttccatcactactctctatcttttttcatgttaaatgtgattgttttcatgttttataaatcacctcttaggaaatagtggtattctcttaggagattttagtctagggtatgtggatagaaataaggtctgtgaacttggattgggggaaaactttatctttatttgtattcaattaaaaccaaaagtaagcagttttttcagttaaaatgtgagcaacaaactccagcaatagagatacccatgactttgtcactaatagaaatgacagatacttttataacgtgttccagacattgtacatacttaaaaataccagttatgctcgtcatcactacattgaaattatcctaaagacctgatgctagatcttgttaattaacatattaggaaataaaacatgtattactacatcacaaatatttaaaaaatgtgttgcacattgtatttcagtataattgttttcatttaaaatcctatgtattttgttttatgcatttaaaagcattattatgagaatgggtttttaagcttcaacagatgccaaaaagatccatggcactaaaaggctaaaaaaatccctgctgcagaaatacagtagcaccatactgtagaattttctaagggcagtttcttatttgtggatggattttcaaatatctgcctttagccactacatgtataaattaaataaatataaatatatttagttgaacaatatgtatgtttattaaatatttataatgaaaaataagacatgaattatgcttatgtacatatatatgttcatagttacccaacaatgaagcttcagtatatatggtatggttttcatgattcattaatacatagttataggtttaaaaccttgcagaatcatagtaaccatacagaaagccgtttcataagcattaaatcttaagactacaagacattacttgaaggtcaatgctctccttttcacaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggtaagagaaaaggctagaagcttttacacccttctctgtcacgagaaaaagatacataagtgaccagtaacaattctgtgtttgaaaatttctcaattctacgtatatgctggctcttaattcaatatctataacaatattttaatatatttttctttatatttacgcaatattctatatgaaaataccacttaaaactaatctcaatgaaactttattgttgtcttttaaacattttagaacataggaaaaattctttaagaatattgtctaaccaataatgccatggtatgtctctgtacaattaaggaataccagaaacacatggaaacttttgaccagaatgtggaccacatcacaaagtggatcattcaggctgacacacttttggatgaatcagagaaaaagaaaccccagcaaaaagaagacgtgcttaaggtagcaaataaaatatgaaaagtaatgtccaaattgtacaccagttacttcaatcatctttgtcctaaaagatactaaggacgtcttaataagagtaaaacaatcctttcttccttcctttatctttccctttttccttccttccccctttgaatggaaatgaatgattttgaagagttctgtaatctgactttctgttcaaatccatcactcagttaattatacccaatgtaaactccgttcagaaagatattccaagatttattttgaaatcatattgcaaatttctgcctttgtcaatggtggtactacattcttgtgtctaacacaaagaacaatctgacactatcattcatttagcccatctgaatgaacacctgaaatccagtcagctgatttttttgcctatgccatatccaaatcttggtaattagtcttaatgttgggcttatgtaaagctgaggttttcatttttaactacatgtaaactaggctttgggttctttcttttagtctcaaaactgactgttaggatgccctgtcttctttttcaaggggaacttaatcttttctttaaaaaatgattccgataaaagggtatgagaggtgtaatacgcaaatataccttatagacactacattgtttctatttgatgatgtctcttttcccaattaaataggtagagttgaattttaacagctctcttttcaataaacattttttattttgttttgctgcaatgtttgataaatttattgattagttgtttactatttaaagaaaactcaaaaattatgtttctttctatgcaatttatttttatgcctctgatattttccacagattacgatatacctttaatgaaaaactataaattcattccaggctatccccaaaacacatttatgccattgtctgaagcttattttgatgtggatctgtattgtgctcttcattatcccttgatgtatagtcagagatgtcatcttatggtgaatttccttcaaggctttttgaataatagggtctgagttatttaacttcaacctctgtgacccggcaggtcaggaagaacattcctcagtacctctgtatgtgacagaaaattcgtatgtgttagaaaatcactttttttcttatgacactcaatgtaataaagaggaacttgaaagtgctaggaaggaatagaaaagtgttcttcagctacctgacctcctgagcacatacttagttcattccacaactattaaattcagtaacgatataataaaataagactaaatagaatatattatgatagttgcaacaacatagttgggaaaacatccctgtccttcctcggactaaataaacattttaaatagacatgcatcaaacttaaggacggtgatctatttttctgaaatcacacgcattttcattttagtcctgttttatggaagttgtggttttatctccctttgtattttctgcatgtgcttgctctcattttcttactttctctctctctctttctcactcttctcgctcacttgctcactcgctctgtttggctctctttttctatcttgaccttcattaattactaacttcaagtcctatctcttgctcatggaatatagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggtaggaagatctactccaaggtggaaacttgtgctaaatggtctcttgcgaaggttgcgcagtactctgaaaggggcaagtagaccccacagcaaggttttcaaaaggaaaatgaatgccaaaatgtatttaaggaaattttaccactgattataatgggagataaacgccactcctccccgtctctgtctctctctgtctctctctgtctctttttctctctcatcttttgctgccatagatattctaggactgcattctatgctgcagtttacatacgtactttcaggggtcacctacagaaaaaaataacaaatagcatgctgaaggccaaaaaaataaataaaaccaaaagcacacaagtcatccatcaacataaagcactaccgataaattttgccaaaagcagtactgatacaatattgcttgtatgtaatgtggatcaaatatccaaaatgaggtcttgtacatcttctgcacggtctagggtgtttttttacctctttactggttgtgcaagtgtgtttgtttaacttgcttttgctagttgtagacactgtgacaaaattcattaggctataatgaaatgatcacgccatgaaaacaaatcattgcaaagcttacatatcctaatttttgtaattttatatgcctatttatattactgtttaagaagaaccagggaatatggaacttttgcgtgatagactttatatttgtgtatgatttgatgaagagaaagtcttatttaataagtagtttgcaaaaatgtataaatatagtgttatagaatttcagctctttgggaagatttgaaatgcaagtaattacctagaaatttatatactgtagtttgataaatttcaatatatatgatatgctttcaaacataaaaatgtatataaaatcaatatatgtatttaggtatatagataattgttagaaataatctgaaatgaaaaaaacattggagtatttatgagaaaatatgatgcagtatgtcaggtaagtattgattcctggaaaaatagaacattttcaaaaaatattttgatagatataagcaaccagtaatagcatggtttcacaattgctgcactttctaaggcattacagtgtctcatcatgttatataatagtacatatttaaagtagttttcaaaataagtgaaatgtgacatgataaattctaaatagtttagcttgtatgcatgagacacagttacccttcaaaattcaccttcccaaattaaaaagttgttagtttaccttaattcattgcaagttatttttaatagttaactacttagttctcttgtactctctctctccatacatagagaccttatatagttgacttttaaaaggctatattctctacatatggagagagacagcatgagagaacttagtagttaactgtcacaaatatatatatttgagtcagtcattattacctgcaaaaaaatgtgacaggctcttaaaattgattaaagttttgaaagaatgtattgttacttacaaagacaattgtttttacttctaaagatatcaatggcttatgtaataacaagacaatgaatggagatttatttcaatccttaaaaaatgctactacttcattactaagatatagacacacacacatgcacattttaataaatcactaagctatagaatatttaagagaaaataaggtattatctttggataaattgtgttacaagattgtggttcacagatattaaaaaatgggtagaatttgctctccaccacagatgtgacagacccagccaatacaagtttgtgaccaagacaagtttgtgagttttcatttcacattctgcatgaatttgtaagtatacttctggaaatcatgcataaagtgatccactctatgaacttcttttattttccctagaaacataaggcataagaaatttccagtgaatattcatttattattattattattattattattattttgtgtgtgtgtgtgtggtggagactctctctgttgcccaggctggagtgctgtggcataacctcagctcactgcaacctctgcctcctggaatcaagtgattctcctgcctcagcctcccaagtagctgggattacgggcgggcgccgtgacacctggctaatttttgtattttggcagagacggggtttcaccacgttggccaggctggtctggaactcctgacctcaagtgatcctcctgcctgggcctctcaaagtgctgggattacaagcgtgaaccactgtgcctggccccagattttcaattatatgttaattaacaaaataatcacatgtttgcttttcaaagtatttgtttttctctaaattagtaaaggcaactgagtgtaacaatgaccccattttagggctctgaagagataattatgctctattatcacgatgaaatgaaaaacacagaaataaagcatatctgacactttgcttatatattcattgcatcagctaatgggattgagcttccattgtgttagagattgtggtgagaagatacaagggtataaagatccttgcttaagaaatacatgttttcaaacagaaatgaatacttagtataatcataaaatatgtttaacactaattcatcttcatggggatgttcaaataatggtgagatgatctcggcagagagaacaatagatttagaaggtaatctcaccagagaaaacagtggatttagaagattgagatttaggcctaactttttcagtagtagccagaatatgtgatttttctgcatatccatttcattgtttgtaagatgaggaagttaaaatagactaacaatttttaaaagaaaacctatcctgcccaaaatattattatttaaaataaagtattaaatttaaatatttaatattaaaatcatattatttaaaattaaattaataaattggaaaataatagagttactagatgggggaaatatctgccattttatctttctccttcctatgattgaattcaggaagtataaattatgctcatagaacatggtttgaaatttctaaattagattagttcataaatccctgctcgttctaaaatttggctattcagtaatcttttgttgattacaataagaaattgaaaacatttaatgtcttgtgtgtgtttgctctggagtagggaagtgctgaagtgctggaggttttagggggtagcctttgatctcaaaatcaggtttctttatagtaggggttatacaggataatattaggttagaatatggcttttctatggttgagtctatgtctaagtttcatggaagagtaacctggggaaaaaaaatactatggtgataaaaaaagtagatttggattgaacacgggtaggtcatagactctttgtaatcagtaatttcagtatagcctttagaacataactctaaagagcccttgaatagagaaataacttatgctgaaaattcactggtgtctagatttactatttggtgaagaatacaaagtggggtactcccatgtctcctgccaggactgttcatgacaagaaattccgaagcccagaaagcagtgagtaaagggatcctcagttcagattggctgaggacttgactgtccaagtgcagctctctgtaatgttaattttggcctcagcaaggagcagtatggtgagagcaaaaagtccttaacttcaagacacaagacctgctttgagcactagctgagcacattactacttagtgattttggatatgcctctttacctctcagagcctcatttctagctacaaaataagggagatgatgcctgttttattttaatctaaagattgtaatgaggatcaaattatgtaatatatgtaaaaacatgcatttaaaatgtattaatcagtgtatagatatgaaatggttaaaaataattaatatcaatgggtatttccatcgttacgtatattacacttgaatggccgaatctggggggttgagacaaaaactgatggaaaaaaatgaaagaattgctgattttctgtggtctctgctgtaatcgactggagtcagaaaatcgtgtctttgctattttcatgacaaagaccagccttaaagataatgaagtggatgaatttaagaactactaaggagttatgtttgtcccacatacgccccttaaaatacataaaaatgctgccttttcccattttattaaggttacctaagagtatccaatgactttgaaaaaagcgtgttttttcgtaatctatgtgaaatcaatgtgaggaaatggcagttttaatggagaggatcagaattgcaacagtcaatcagagataatattagaaccctgagtaaattgacagaatcaatgaggagagactccttgtctcaactgtctctgttttagggcatcggagtatagtggcatggctgagggcaagtggataccatcgggaaaataaggtgataggagacaaaagtataggaaggggcatgggaagacaaaaataaactgattatttattcatattaattatgacagttctacccctctccatccctctagaagccaagttggagaaggggagtcagcaatttgggagagatgctagttgaggtatatctaaaagcactaatgagtgaagacttgagaaaagggattaatcaggatgaattctcaccaaccatatattattttccgataacagtgtttggtagtgagggggatctattgctaggtaaaatacgatggattcaaggagcttactgtttgatgatagggcaagatgtgttcatggatactagattgagagtgagtgcatggtaagtgagtttagcagtcactccagcaacacagaggaggtaacaattcggcataaacatatgagaaagcttaggagcatacagtgtgttcaatgaagagtgagttcctttagttttcagagtagagggcatggaagataaaacttagttgtggatgataaggctgaagattatggctagacacagtgtgaagaggtcatggacagccagactaatcattcatgcttaattcagtatgcaatgaagagttcttgatgtgctctgtgtgtgtgtgtgtgtgtgtgtgtgtgtgtgtgtgtgtatctgtgtatgcactgttgagaaattagtccagtgatagttgtgaggagaattccactgaataatgacatgaagttcgggagctattgcagtagtctagatgagatacactgatgacctcaaaaaaagggatagctatgggagtggaaaggaaatttcagtctagatcagtaaatcttttgtatgcacttgggtgaattgttaaaaccagtgtgctgggccccacactcagagcttctgactcactaggtctggagtggagcacaagagtttgcatttctaacatttttctaggtcagattgatgctgaaggtctagggaccacgcttagagaactgctgctgcggagatatttagaggtagcctagagttaagtcattacatacaaggacccaagaagatgatgaattcaaaaatgactccaaatttaactctgattgactaggaaagtctgcatataaattccaataataggcctggtgcggtggctcacgcctgtaatcccaacactttgggaggccgctgcaggcagatcacctgacgtcaggagttgaagatcaacctggccaacatggcaaatccccttctctactaaaaatacaaaaattagctgggcatggtggtgggcgcctgtaatcccagctacttgggaggctgaggagggaaattgtttgaacccgggaggcggaggttgcagtgagccgagatcgcaccactgcaccccagcctgggcgacagagtgagattccatctcaaaaataaaaattaaaaaaaatttcaataataaaatatgcatcaagttatatttttattgttgtaatacttagctgcaaaataattttgactaaacaaactttaggtgtgtcatattaataaaggcaattattttactttttacaaaatattatgtaatttctacataaaatttgcttagattgtatttttctagagatttagatatacttcactgttctaaggagctgaaatgttaaattatttattctgaaattgatactaaccagaaaaaagtgaaattattttctctgactttgatcctttactaagacttatttgctataggatatatctggcatatgttctttaatttccatataggccttgaaaattgctgctaaaattcatgtagcagtttctatatatatgtattacaactgtaatatgagatttggacaatcgggcatcaaatacttaaatattcattgtttgattgctgcaataattgtaaattaccaagtttttttttttttttttttttttttttacttccattcagtgtcagaagatataaaagtaatcattctttggataagagactttcacaagtttataggaggctgtgagagagtcagtgaccttcccatgtaatgtagaatatataagaaaaagaaacacatgattgggcctaatctatcttaaaatatggttctatgtgtggaaaataattaagcagtgatttaattattttggctctcctaaacttcggtgggaaataaatgatgcattttataaatgtgatctagaaggtccaatgaagatgtattggattgaaaatttttaattaaagcttaattttctgtagtcagatttatcaatgcaaatacattgatattttgcagtctctttctgatcgtattataacttaacacctatgatggaaaataatattgtatcttaattggaacagtattcttgctatatatattctttaaattttaatttttttaatttttgtaggtacattgtaggtatatagatattcatttttagtaaaattttctataaaaacatgaaaactgagatgaagacttgtaaatattgcataatttgtagagcattaaatatgtaatatttacaactaatatcttcaggtaatagtaacagatcactagtcaaactgtataatatctgcaaattttattttactaaaatgaatcagaaaaatatgaacctaacaacataattcttatgttagcttattttttccacatgtgtaattggttatccctataacaaggttaagtccattgaaacttcgctaataaatccctttggtaaccatgtaaaatatttttaaagtagatgtgtaattgagtttggtgagcagtgtcatttgataaaactatctgggtcttgttagcataacatttgaaataattaaagctatttggtgaatcttgattgttctcctttgataaaggaaaattagtcccctgatcagtgtcagtagatgtaaagcaattttgctttggaccagagactttcagatatttataggaggttgtgagagtgtcagtgagttgaccaagttctcacagttagacagtgtggttagcaaatactagatctcagtccattgctttgtccacttcaatacactgactcagcatagtttactgcctctatttatgtcataaagtagtttttgttggtctactatgtgttagtataaacatacccaatttcacttcaaatacagtgatttcgttatactttttgtattaaaaatgacaagaacaaaaggtggtagggaggaagaaatggaagaaggaagggggaatggaagaaataaaactggaaaacaacctaagtaaatgaaaagaaagtttaaaatacaaaattgcttaaagtgttatgtttttacttttgtctgtctcccccatacattttagagttaaatgttttcctcttttaattcatttcctactccaaaaagtcatgtaatcatgaaatagggcaatattctaagttaaactttataaaaggtcgacagtaggaagcagattcttgacccacgaatatattttgcatccagttttaaaatgtgtaagcatgaaattaacctcatccatacaaaatcaattgaaatctactgggtaatatcctctaattagcctcacaaattagtcacattttcacatttttattatcaaagcattaaaggtaaaccagtactttatctattctcaaaagaatgcaaccaatgaaatgtcactatttggagtcaatttatttaatttaaaaataatatttcttacattttcttgtttgctctaataattttaaaataatagaataaataagtttataaaccatattttaaataatctttcttctagcatagatgtagtatctttccaatacacttatttgtttttgtaagttcttttcctctacagatagaatgatgtgaaataactcttcatatcatatcagtagtctgtcttttctgtactatagtgtgttacttgtccttgaaatttttcatcttggtttccatgaattctttatttttctatatcaatattgtaatgataaataaattttcaaagctgcagaatggaaaaaggagactgatggatttgaagcaattttaaaccaatctgtagcacttggattatttattttcaatttaggttttagtgtgatttgaatatagtggtaatttatcatgattattaagattccatagtccagattaacaaatgtttacttgctgtctgtgtaaacacagtcgttattatgctagtgtatctgtgcatgccaaagtaatatttaaccaaggaaagcttacattttaaaactaataaagtgtatctgagtaattttgaatgctttcaatttacaatgaatcagtttgtaattgatcttgcttttcttcagtctgttatcctttgttaacttgttataaaattcagctttaatgccaaaacttcaacaaagccttaaatttcattaatccttaaataatccaacaaagcacaattaatagttgttaagcaatttgaaacattaaaaaatcaaggaaaacaaagtgttgtctttctcggtttctctgtctcttctttatgtgtccatttatccatttattatacttccctgtcttctaatttatatgtattttgtatgactgcacagtcatgctaaagctcttaaaatgaaaaggtaagtaaaaaattaaaagtgtccaaaacctatgcttggtatacactttctcatgcaatattataacttttgtttgattattttctatataactaaaacctattttgtgtgcactgtctaacattgtgtgatttaattgtgattccagttcttttgtggtcatctatttcctttaaagtcaatagaagtaacttacccaataattaagatgatttatcagccattgctttcaactgttttagacaatttatcataattctgaattgaaaagcaggcatgatatactttgtgttttaaaatttggtgactcaagaatgagctgttaaattataaacgctttcttattacatgtttcctttataaagttgcataagaattccaagttacaaagacagggaagaccaaggaatgacatgtagaattttaattgggtgggaaagtgttttctgttttagaatgggcatagcctaatgctgaactagtgaactcttaagaaaagcaatgaatttttttcatctctttgtgtccaaagactattaatcatatggctgtcaaatggctggtgctatcttgccaataacatagctaaaacaattggtttgataaacttattttggttataaaattggtcactggttgattaaattaatatataggtagttctaaaactaccgattgatataataagcaccttttcctgtataaaataaaaggcagtgttttcactggaaaatagagtagtataagacatattgccaactttaaggatggaaaatttatttagagagacaagcatatatctttgaaagccaaataatattatattcctgtctataagaaagcagtgcaacacaagctgagatacacataaatgagaatagaaactcctgaaataacaggtcaatcccactcccgtaatttttcctataccccgaggactgcctgaaaatttcactcagaacacataatgcaagataataagaccgacgtaagaataatctaaattcaccacaagttataaacaaaacattactattttattcaaagtaattatgagatattagttctttacaatgttatgagtataatggttaatagagctctatactgcctaataaggtggtcatgaaccacatgtggccactgagctttagaaatttggctactccatgttaagatttataaataagtgtaaaatatgtgtgggttttgaagagaatataaaatgtaaaatattcatatttttgtattgattatgagtttatacaataatttggacatctcagtgaaatcagtaaaattaattttatctgttttttgttttttactatggcaactagaatatttaaaattacatatatggcatgtattatatttctattgagctgcactactataaaagttctacttgaatttagagacaagaacttactgtaaggttataaaattttaagaaaatgtctgtgtgaaaaggattttgttcctaaaatgtgactgaatacatcctcatctagtctctgcttataaacatttagcattacttgaaaatcagtgtttttaaaaaaattgcagtcctcatcagttgttcttatataaacctaaaatttaggctccaaataatttttgcccactgattttagttaatcactttgaaactacacaaaataaaactactcaaattcttaatcttcctaatttttttaaacaaaatgcacggtagtctttcattggaaaatttagaccctacacattgaactaaagaagtctaagtttccattatcttgcctgaataattagcacttcagtttttggtagtctctcccaaagctctttttacatcttcccccttttttgtgtttacctggtggtatcatgttgcttagcatttgggcagcagttaatatacatactcatataatgctaaccagtcaggtcttttgacatttctacatagaaattgtgttatttaaaattccatgtcactaaaaaagctccttgaaatgtctattttggccctcaatttttagtcttttgttcatttattttttcaggaaatatttacttatgaatatttactatgtaccagaaatgactgtaggttgaacatgagaaactcagctccataggatgtctagggaacacaccccactgactgtatctgtggtatgccttttctgtctccaaataattcctgattaaaaaaaaaaaactgcaccctgtaaactaaatgcaaggctgtgatatcactttttatattgccgcagataaattaatctgtagttttgttcttcaggattatgtaactctaccaaactggaatctaaaatcctccatgttcaccattacaatgttatgatttcatcaaatcccttggtaaaataaagactcattatatcaataagcatgtattttatcctttaaaaccatagatttcaaaggaggaagggcttgacctgagccaatggatgattaggattttgagaggatcaaaataagacccaagatttatagagcatgtatttatattggatggacacatagaagtttgagagaaaataatagtcaacatttattaagcttttattatataccagacaccattctaacatatttgatcttagtaatagccctgtgaggtagatattcatcttatctccatgttataaagaaactgaggttcaatgaggataaataacttgtctaagttccctcagctagtaaatggtagagcccagattcaatctatgcattttcatacagaagtttatgttcttcactagaagatgaaaagtattctaaggtcattgaaggaggcataacagaagatcaccaaatggcctgcaaaaaaaggtctatattaggaacacttacataaggctggcaagtctttggggcaagattaggagaagccttgactactgtgctggaggttggactttattctatttatactcaatagatgcaggaggttcttcagcaaataaatagcataatgaaagaaaggtttttgaaacatagtaagctgatcattgggcacaggctggaactggtttgactgaaaggagattttacatcttttcaaagcttattgccttagttttgtgtaaggaccaggaacgatggagtctctgggaatacaaagcaagtggatcatagcaagtcaattgacacttacttgatatttattagacattagagtgagatgttcaaaaatagcatgacttacgttttacgcctgaatgactgagagaaatggtcttccattaagagaactagggaagttagtattgtaagcagtttgcgggaaagataatgtgctccatactaggaatgtgaaacttcaggtgaaaattcagctggctattggagagtctagatgggaattcaaaagtcagataacagcttagggtgaagacttggaaggcataaaaaattgttaaattcgtagaaaattgtatcttaaattaatagaagttaaattcatggagagatgagctagagaagaagcagttggaataaaacaggtaaatctgactgtaaatagacctatgttcttctgacatccaagtacacaataaaagttattttcaacattatcattatgtattcacaaaatcacatagaacatagttgctttcattaaatattagcaaatgtgaacaaccatttaataacataaaatatcaccaaattgataattgtatagttatgattctaagggttgttaatctttttacttttaccgtcatctaaacagtgtatgattttattgtaccgtaattgctaataatacagacattgaaactttaagcatgtttgtaccactaccaatctatactggttcaaataacttatgatatttcaaatggcaaatgatcattaggatttaaaaactggtactgtaataggtcacttaaaattatctcataaatctttcaggggtgtgtagaagtacctagaagatatgtggttattcatgttgcatatgagaatcatgtcatcatgaatagaatttgattattcacttcttcaatagtgacagattattacctttagatatttagtttttcttctacacttatccgtattgttcaccagaagttgccatctaataaaaattcaacctcttcctgggaatgtgactggagaagggtaggtggggaccaaacttgatgaatgtaatcgtcttggcaaaagacacgggggtcattcctgaattggttttacaaaagtaaaatgttttagctctgaaagaaaatcagatttctgtatgtcatctatgggttttcaagagctatcccatataaaatatgttctagtgttttaatggaaagaaatacagcataaagattgagagagtatcaatgtattttattaacagaattttaatctaataactaaaccttgcccacttttttgaatatatatttgattttccatgtcttttcacttatcactccttttcaagggttttgtttagaaagtcaagagattttaaagttttcttagactggtcattatcagttcaaaagtaaagaaactgatgtttacaaggttgaaaagcatagattctttatgtgaaatatattaggttcattcgtttgaatttatttgcatcaccaaccaaactgttcctaaggcaagctaatggcattgtcttagaagagcatgcctgtcaattgtgctgtgctaaaaatgtcatttaaaacatctgagcagattgccatgtagtttttctaaggataagatgacaattctgcatttctacctgaggttactgttacttgataaatgaggcaatttctgatgagacatatttacccaaatgtatttatatcagaatatttaaaataaggtcaaatttgactttagaatattaaaaattagcccattcaaatgtatctgtaaattgactgttgttgatatcaccaaatgatgaattgtactatcttgcatgtatgttcagctctggtgatgtgaaatgtttctccttatttgcatcctcaggtacttttccagttgtatttcaaaacccttcataaaacataatatggaaacataatgcatgtgattagtttagcaacaggaggttgaataaatgtatttcttttggtttatgtttctaataaaaagtaattttgatttaaagtagcactatctttttttttaggcctccattcctttgaaggaattggagcagtttaactcagatatacaaaaattgcttgaaccactggaggctgaaattcagcagggggtgaatctgaaagaggaagacttcaataaagatatggtaaattggttgtgataaaagtgtgaatgaactaggagtggaaataaatatttggaaagaacttagataagtctccaactgaattttcagagcacatattacacattttatgattctaatgaattttataaatgcagaatattcttggccttttattacaaatgctgaattactatggtatggtaatataggagcacttacggtttctaataaatagcccagcaattttcttttgacctgacctacttttgaacttatcaagggcaaaatgtaattggaaaaaagagtcgaatcataaaataaactaaaaatttaataaaatactcaactatcatagatgactgacattttgtatcagcaatgtttttggtagtataacatttatttcaatgaagagagaataatgcataatatgaacattatttattacaatttcccacaaagttgttttaccaaatagttgtttagttagtacattatatgtctaaaatgtgtataaattcatgctgcttatttcatgggagtaaagaaatatgaccatgtgtgctcttcccaacctcagaatattctccttcaatcccaactaatttcaaagtatctactacatttctctctggcttgaatatttgtacatcacatccttattaactgactttttttttctctcttcatcctccttttcacaattttttcccctctttcactgccatcacctctgtggcattcttaacctttacaattaccagtgctagagccttctcagacaatgcttgaaagtgacatcagaagacaatatataaattttaggtaataagtgtgtgaagcaataggagaactattcccaccaatcttagttcccacttcctggagctgcctcaatcaatactccccatgtatggggtttggtggccttgccaactcagcttgtggaaagacggaagaggctttccaagttgctgagttacagcaatctctacttcaggtcaaagaagaaactagagggcaccaagatgaaaaaaagtactgattacctcttgggctgaccccaactctgccctagagccctcaactggtatagggaaagaagtgaagtgggttttttaattttttgttgtttttgtcctcagccctagaaaatgctacagacttttacaacaccttttaaaataagtaaagtcttttacagactataagtatatgatgtgtctatattatgataagtatataatgtgtctatattatgccgtatgtttctttagattattgaccagtctctgacaaaaataatccctttcccccatacaaaatgaatcagtcctcagttgcgtgttgaagtttatgcattatagatttaaatatataacatctaattccttgaattgtaatacacacatacaaatacttgtgacttttgaaatttattatttgttttccttatgtcatcagtgtaccttgagtaccattacaatgtgagactacttgatacaaagttttcacattctgagttgaaagaaagaaaactaaaggtgaaaaatcacatggtcatatatgcgactatattagaccagcatttattcaaaacattttatttctaagtaaagaaaattaagatattgttcttgcagcctaaaggaacaaaatacccattgaaaatgtttaaagccattttccagtccatattttagtattatttgatcgtatttaaattaacatgcatatatgacatattttagaaattatttgatggtaacttagcacatgatttttattaatatcctgatatttctcctattaatattgagcatttaggtttcagaaatgaagcaggagttattagataggaattagtgtacatttaaatcaaaatattttcatgtagttgtgtgttaatattttcagatttgctgttatctcagtcacaaatacacatctgtattcctttatggatcagttaacattataaatgataactttagctcatttctctaatgttttaatttctagaactacactaaaaaagccaaaagaatactttcacagtaattcatgacttgtctgacatgatgaagtaccacactcccccatctttctacaggtgcccctaaaaatgtgttctttacaactagatgggaggaaacttattttgaaacctcaagtaccaaatgtaaaagaaaggctatgagcacagtatcttataatagcattccatgaaagttttaaattggatttttgtgtgtgtttaaataacatgtcttattatctctgttaacaatgtacagctttttaaaaaccaaaatgaagactgtacttgttgtttttgatcagaatgaagacaatgagggtactgtaaaagaattgttgcaaagaggagacaacttacaacaaagaatcacagatgagagaaagcgagaggaaataaagataaaacagcagctgttacagacaaaacataatgctctcaaggtattagagctaaaattataatataccttgcctgtggtttttttttaatatatagggtaaaatataatgtgcattaataaaatctgcttcagacttagtcatcagaaactcactttttctgttcaatgtgtatgctttatttaacatttttgagtggtatttgattttgaacgatgtgttgcttaaaagttatggctttttaaagacatatttttctaagtagtaattgaaagatgggaatgcattcatagtacttatacatttaattttctaatgtgctttatttttatcagctactttatattgaaaaaaacctgcctaactgccagaataaccgatctacatgtatccattattcctgctttctttacttaattgattttgcttgcattaggtccaattttttggtaacctgatacttgtttaataagccctagattcttttatttatttttaaaactttattatgcctttaagaaagtcactctttgcaactatctacaaagtcaaatttcatttatgtaggaatcctaaaaaataatcttagtgcccttgaataagaactgctactttcatattaagcagtgtagtgtatggcttcaagtccccaggtgactcatctggtttgtgcaggaagagcaggataaacttaatttttctataataatatctaggaagttcttgagactagacatgtggaaagttttgtgaaactttttttttgtatatgctttgcaataatcactatttgcatgcatggctgattttctaatacttttaattgctgagcttttccttgtaaatcactcttttgagctatgtagttatgaaggtggatccacctagcaggtagatggagtctgctttctacatgcaaataagagaataaaacctttccccctatagtcaaccaaataaacactgctgagaatgtaattacacaatattgtgcctgcaaggaatccacaaggaaagtctaattggccagcaggtgttctgaaggtaactgctgataaatatagtaaacagaaaaggcctcttcctcgagggagtgcaaaagcacaccataatgtgtctagaaaatcggaacgctatgtaactcacacccttccaactgtgagcaagctttcagaagtatctacactggtcgtatgatggtgtgtgtcctactgaatagcagtgtttaatggtcatctggcattcctctaaagaaatctacatgacatctctaaatattttacatattatacatcactttgtgcttaggaaatgaaagatgtttcagattgatgaccaccaagccctttctcctggcaaagatgtgagttatgtcacaaataaggcatggctcaactctaattcacgtggctgtatcttgctacctttgaaaaaagcagcgttcgatctgactcctcagaaggtttgaaaattcaacataaaacataaagtacagcaaggtttaaattcccaattttaaacaaactagataatgaaatgtagttcattcttgcaaatacaggctataagtgattaatcaaaatcgtcaacactactcgccaaaccaatctataccaacatattcaataactttttaaacctgtcaaatagttccaattctggtccttatgaaatattttagagaaggtcaaaattttccaatggaatgaaatttttagaaattccctgatatttattattttttcgctcgaattaaacctgtgaataaaaccctaattgctactttctgtagaaatgaaagctgcatgcagagcttatgttcccatgaattataaaatggcattttgagtaattctattaatcacagaagatattgagtgtgcttgtaaagagcatgatgactgatttcctcccattgttgatttattaaattagtcttatcacattgatttgaaagcatgcacttgctgttttcttttttcaaatagttaattgttttgcatttagagcatgatttggtatagtaagataaatgtggctatgcaagccttggaaggagaagcatttatctcacataattttttattagttatgttcaccaatatacgaacagtggtgacacttctacacatacagcttggaacagtttataagacaactaaaatggctttatatttctaatcataaaatattaatggcctatgaaactcttatgtaggcatttctaaaaacatgaatgtatattggttgagtacataaagttttgttgatgagccccaaggctaaagatatacattttagaattttacctattttaagtcagatacaaactcactaggtttgtgagtttgtatctagttaagtcaattgtattcgtatattaaactcttgcacataaactacacaacagttagctcattaagagtcaattgaatgtgacaaaatttttaagcaagtttgaacatgctaagagaaaatactttaagtgtgttattcaggtttcttagcttcctatacatgggtcccgcctcatgcataggcaatttaattatgtctttgtatattttgcatttaaatatgattttaacctaagttgtacaaaaagatgagggacgcaaattattttgataaataactgcagccagaagtgcactatacatatatattgatattttaataatgtctgcaccatgaacaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggtaatgttgttttagaatgtcaataccagattttattatacagtttaattaacctgtgaagatcatatttaaaatgttgatgttcttgtttctattaacgttctctttgatttgatgcatttccttgtattgtgtgttgttttcagtaaatgtattgtattaagtgttattcaattgacgtaatgttgaatgaataaaatgttttagactatgtaaagtgatttaagaaatgtgatgtgttttctggtaaaattgtaattgactttgtgtatctttgttccagatgaactaatgacttatcggtatatggacgacttcttactcatgttagcccattcatttcatcagagcatcttcacacatcagtgttcactctctatagatttatttgcatattgtctaaatatgtttttttctgttattattttacactttttattttgcttcattctctgttgagttcctcaaacctttaaaaaggaaataaataacttattcacttaccctctaaattatattctatgtggacggtccctaataaataatgagttatcactccaaattgtttcaaatcccaagacaccagaggaatttagaagaaagaaaatgttagaccaatttcaatatttacttaattagaatatctaaaaccaagcattcaaaggataactgaaataatatttgggttattgagcgaggatgacagtcatgcctttcatatttgtaaacttcaaaggatgacaataaagggacaacagcctttgaaattttgagagaagtatttgctgcttgcaagtcggttgatgtggttagctaactgccctgggccctgtattggttttgctcaataggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattgtgagttgttactggcaaacccacgtatgtgtttgcaactactactctattaacagaggcctactaataaaaaaaaaagagacaaaaaatctgggtacagttttaaacttctaatgtacattctgaaagtgagtggtttccctcactttgggcttctgtaacactagtgcttaattttgccaattaaagacacaagaaattaacagataacagggaaaaccccttatcaaaaatgaaaatacatcttaattttttttgctacatcatttttcataacattggcaatgttaatttgtcaatttatcatacattcactttacttcaatgtctaatccaaaaaatatgtattgctttcctgagatcatcccatgctgattttactttcttaatgtatacatgataaataataaatatttcatggtacatcttatgtcaacctgcataagccattatctcattgacttgaagaataatagcttaatcctcacacctggtttaactacttaatgggttacagtgcccataaaagaactggatgcctagtaagatggttgctaattgattgcagattgaacaatatcagataatgttattactgaaatgttaccagccaaaacaaaaaggagtgactgctcttctttcaaacaactgaatggaaagtgtatggttctctctttaaaaaggcgattcagaattgttagcttggtctcacttctttatttgtagtaggtataaaccatagaggttttctgacaggtacatttttgttcctattattaacacttgtaagatgaagaggaatgatcatcatctgtaattatagaagaaagtactcctcacaaaaccaggatgtcaaaatctggaaactaagtctttatagttaagttaggttgaattatatgaatcaaacagatactcaaccattttgccctatgtaaataataactgcatagggttcagcccatgtatgagacttcttgggaacttcttctgtgatagtgtcagttccatttaatttggtgtatatttttaaaatgtcaaaagcagttaccataacttaattttataagcatataagggaagtatgttgcatattattgtgacttcttttaatacttcaagaaaattaataaatacactgttttctgttaaatctaataccctaaagtttaatagcaggtgaattattctgagcaattggaagaatacgagaaatagcgaaactgtattgcatgtgaagtctaattccacctggctgaatgtttcagcctattatccttcatattagatgttatgaatgtaatgtgtcataaataaccttacactaaccagcaagcctgtgtctgcagatgcaaaatgaagcgaaagattaaggcaatcaaaaagaaaattctaataaaatagtttcacctcaatttaatagatcattcaagggggagtcctttgctttgaattatctgactactaactcatttctccattccaattttccccaggtcttgacacacccaatatgcaggtttaaaattcgttacaaactaatcaagttgctaatgctttatggctaaataggcacaggatcaaaaatctccataaaccacttacttaaaatgccattatgtccctattcatagtaggctctcaacaaatatttgtacaacgtaataatgactggtgaaataaaggaagcatgtgtgaaccagtatatatttttaaaaaattgtagtaaaattctgggatatattttcctcataaacgatttattcttaagttttatatattaaagatccaaaattcagaatgtgaagggggctatttttgtgttaactcttaattatccatgataataaagtaatcacaatctgtatgaagaataatcaatttaatattgcagttatatttggcatcgtattttaattagaactgagggataattgatagatgataagtaggtatataggttggtaggtagatagatagacaggtgggtgtagaaatattcaagatacatctttatacttgaccaattgtcaatgcattttaaaactaatttcactgtggccactgattagagttatctttcccaattcttacgccctagagtcatttgtgatagtcacagtaacagcttaatgaaaagtagtatttgatataaccttacaatggctctgatgcagcatatgccatagcttcagaatttcttacctccccctatattctccttctctaattgtttgatttttacttttcctaactgtccctttttgtttttctagatataaactgtaggcttaaagttcatctttcatgtctttacagcaacatgttgaaatagtaagcggtactcttaaaatgcttagtatgtgagagctgagtgagtttaaaatgaaaaattaattttccttatctcacagataaagactcagagaagtgctaaccactgtaaaattaaggcatttaggggactctgtccatgtcagagctatatatggtagtaataaagctcagaaaaggactgagactttgagggaacaatcatgaggcagcgcccagccacacaggaatgcagaccaaagcatagtagagggtatctgcaaattgtggtcctcagggcaaacctggagatgataaagaaagaggcatgagactgggaggacgcaggtaaaaattttaccagatattcaaaatgagagaactcctgccttaattaggaattccaatcatttctaatatatttcctgttggtttagaaactaggttcctcagttaagaccaagcacggactgtaaactgaggaaaagggatagttctataggatgtactatcacagcagtgtggtctagtaaaattaactcttggataaacagccttgaatatgaatcccagtgactttgagtgctgtatgatcagggataaactgagtctcatttacttcatctgtacaatagagataaggatgtttctgaggattaaataaggtaatatttgtcaaacacctgctgcgttatgcaggctcaatgcatgaaagttttcttcgtctcctttctgtatatatattaacattggaaaatagacataatctttaatttttaaaatattttcataagtcattaagagaattaagtacgcagcatttgtttaaaatgttaacaacagatatctcgttcagtgaaaatttcaaatttaattctataatatataagcagatacttttctctagattcacagaataaacacaggaaatatcacacaaatctgatgactgccaagaaagggcatgattttccctaaactgcccctcacatcattgtagcatttggaaaataacctcagagagcccaggcatttgcaaacacaaaattatacaatgaagataccactacaacccccaagggtcatgtgaaactgctaaggaacataagcttacaaactaaaattatgattattgtggaaaaaaattataagcaatgttatcagatgccaaacgttaaaaggagaatgtatacctgaagaaaatagagataagaggataatcaccaaaggatattaagtaatttttaatgttcaaaaataaaaattaaatggatttttttccagtaagaataggccattatataaagtgaaaacgaagatttgaaaaaacaaagtctggaaatgaaaatataattaatccctcaaacatctgcgtgaaataagtttcaagttgaaaaaaatagggattatggggaagagacaatatttcatattaatgaaatttaataaaatggaataaatgtaaattttaatgaatcctcaaattcaataaaggtcaaccaacgtggaaaaaataaaaacaagtctaccagctagctctgaatgaaactcagagcatcagtaatcaaaaaggtatcattaagggttacttaagacaaaagaacatttacaggatgacaatattgactgaagacttttcatcaacaatagatattagaagacagttgaataatatcttcaaaatgctaggcacattttcaaataccaggtaaaacatgattcaagaattaaggcaaaatattctcagacatacagctagtttcacctgaacaaaaactaagaatttcttgtctatagatttttgctaaaataattactaagcaatatatttgtgtaaaataaaatgaaactagaaggaaggagacagcgatgtaaagctgtataaaattgttttctctgtaaataagaacatttattaaaaaagcttataatcctaaaatttggtcagtgccaccaaggaaaacacagaatactaggagaatgcagtgtttgactgatcctgtgtaaagagagagaaatcaaatagaagacttattgcatatcctatgaattacatatccttaattcatatcctgcatattacatatgctatgtaaagggagataaaaacaagacttattcgagataatggcaacaaatataaggcttgtgcataatgtgttctatgtaaattattaccaattataatgtttctagatagcaaaaaagtgctaaacctctgaaatatgtatacatacatgacctttccaagaacagcagcaaaaaaatacaaaaaaaagcccacttcagtgaagaaaaagaaatgtccattttctaaatacatttccacttgagctgagcatgttatgacatcaaataccaagtatatgatcttgatgtttaacattttatatccaacagtctcttatcttggatgcctaatgagcatctcaaacatacaatagccaagtgaaaaataaatgatccaccccccatctacgttaattggcatctaccaacatctccagatgttattaaattgcactattatttacttaagtcagaaacctagacatccttcatgattcttttctcttacattaccatgtaaattatttccactcttgttggatatacctgcaaaatgcatcaaatcactcctccgtatctgttatggaagtgctaatctacaagattattatctctcatctggattacttcaacaacctctaacctcttcttccagtctttccccacttacaccatatttctcctggtgaaggcagagagctccttctaaggagttaatgagatcatatcaggcccctcctgcccattactctttaaatgaaatcctgtgatccgctatatgatgtagccccttcctatcacttctgttactcacactttgtctccctttttgctcttctgctaacatagaggcctaaaggtttcttttctatacttaaacacaaccaatttcatttccatatcagtatctttgaacatatttttctaatggaatatttttcacctagaattttgcataggtgctataacttatttagatatcctttcatttaggaacaatgaatatttagtagaactttgatgtataatctggttatgtaatgtagtagtttctgttataaatgttttatattccctatacttatgtatgcaaattcggagtttaagactgctcgttcagaacatcagtttctcttacggttacttctagaagtaggcatactaaggaaagacacagcttctggaacataaaagtgaggtggtaaaagatgaatatgaagagggttacaatattgtattgcaatggatagcttgtcctacagcagagtaattgtaatgggatattttgacaaaattaaagtacacatttccaaaatatacatgctcttggaaggctgatagaaaattaaccttgtttgtagattaaatgctgcaataaatgtgttatttaaaatagtccttggctgggcgtggtggctcacaactgtaatcccagctctttgtgaggccgaggtgggcggatcacttgaggaggagttccagatcagcctggctaacatatataacatgtcatgtatatatatgacatgctatacatatatacacatgttatacacacacagataacatgttatacacgtatgcacatgttacatataacatatataacatgtacgtatacacacgttatatataacatgttatacacacgttatatataacgttatatatacacgttatatataacgttatatatacacgttatatataacgttatatatacacgttatatataacatgttatacacatatacacgttatatataacatacacgtatacacgttatatataacatacatatatacacgttatatgtataacatgttatatataacatgttatacacatataacgttgaatataacatgttatatatgcacgttatatataacatgttatacatatatacacgtgttatatataacatgttatacatatataacgttttatatatacatgttatgcctatatacacatgttctacgtatatacatgttatatatacatgttatgtatataacatgttatatgttatatatacatattatgtatatgttatgtatataacatgttatgtatatgttatgtatataacatgtttgttttataatgttttatatataacatacacatgttatgtatataacatgttatataacatatacacgttatatataacatgttttatatataacatacacatgttatatatataacatgtatatataaatgttataaatacatgttatatatacatgtatatacatatatacatccatatataacatatatatacaagttatatatatatgttatatatatgtattatatatgttttatatataaaattagccaggcttgctggcagttgcttgtaatccaagcttctcagaggctgaggcatgagaattgcttgaaactgggagacagaggttacagtcagcagggatcacaccactgcactacagcctgggcaacagattgagaccccgcctcaagaaaaaaaagtagtccttaattgaataaatttgtaaaataaacacctatatattgtgaatatttttccactaacttttttaagttgtttgaatctgaatagtattatacattcacaaagagttttcacatgcatctagtttgatcacagtaatgaccctctcaagtatcattttctttgtcattttactgtaagaaaaattagcataaatgaggttaagagatttgtccaaggatacatctgagaaatggaagacgccaaacttgaactcactgctttccaaaacatggtgggagttattaataaaaaaggaaaaaagtttcagtgtttaaacaattttggtaaacagtagattaagcaaactttccttactctataactttctagtgcgtttgatatgctaatgggattatgactttctatgaaggggttagattctatagactttcacatctagacagttgcagtagaaaagggaaatttgatttcagattgatgaaaggtttcttatttgagtgatggtgaaataagaatattctttagaaaaaaatgggaagaacatcaccgtatcattattcttctgttgtttgggatttccttaaatttaagcagagatgtacaagaaaagtaataacagaactgtttgccaccaccttatgtaaaataatgtctgagcctagatttaatggtctgctacacattttttatattgtctcctatcttgtaataaaagcaactcattttgagaataaaattaggggaaatatattgtctttgcataattgccacatagattttcttctttgccttgaaataacaacaaagattgtcagctgccagtgcaacatccttggagaatttgggaagataaatgattttcttatttagagacagaatgttctttagcaaatggaattgtaaatacaaaagactaataatggttgttaagggaaatgttgcaccaggatgtagctgtttgtagaatttttctcctctcagctcaattttgtaattaacatattacaaggattaaaaaagaaattagctaacattttatgtttttctagattgttgatgatcatagtggttataaatatttgtacggagtttttttgttctagtgtctagttgtgtagcataatcagtttaatggttaagtagaggcatgttcagcgagtatcagcttccagaaagatgacagactgacttaattcctcaccccctcacttcaaatgcgtggaaattctgaataaaatataatttttaaaagttttaaatacacagctgggctatggtggaacctctcttccctctgtgtgccatgaatgatcaaatcatcttacgtgaaactgaacctggattgagagcctaatggctaggaagaagttttcaagaccttttaggacaaaatatgtgaccttcaacaacacataatatagaggtgaaaataaaacccctccttaaagtctgaattttcaagggcttccctcagctgtaaaggggaataaataaatcctacccacaatggagaagaggcattatctgtagtgataatagcttaggattttcaaaacttaatagaaattccaatactccgattgggaaactgagcaaatctgaagcagaaaagattattaaaaaaaagaaatataagtatagatcatcactatgagacgatgaatctgatgaatccaaaaaaagcaaagaaataattttaaatactgctgtatttccttagaaagtagtgacacttaaaatggtacctggttttagagcaatgatagaagccagaagacggtagaataatattttcaaaaacaatgaaagaacatccacgtaggaacctagaattgtgtactgatagaaactctctttcaggaataacattgaaataaagatcttttcagacacacagaaaccgtttactagcataaaattccctttagaggacgtcaagattggtctttaagcaggagaaagatacaagatggaagatttaagctgcaaaagaaaatgatgtgcaaagaaaatggtaaaaaaatggaaaagtcttaaataaacatttaccgtgtatgaaagtgtctattaaaaaacagaaaaatgctggacatcaatgaaacatgagaaggtggttaagtttttcatccagtttacctgctacctttctatgtattgtttctcagtttccataggtagtacctacttctctaatgctgaaatgcctcagtgctcagtccttgggcacttgccatttttatttattctatatatgtcttgctgttttcatccagcctcgtgacttgattaaaacaaaattattcttttcccctcaaatgcagtggaagcaccgttctttcaaattttcagagaaaaaaaaaaatctacgcatgctttctttagcctatctctacacaatacacagggacaacatttgaaaaatataaaccatatttaaatctgatcataatccttcaatgaattcccatctatttttaagtgaaatccaaaactcttcatgaatttcaagggatatctgacctggctggcccacttcttaactcaggccttatctcttaatactttcctctgctccacctatgttgacccctttgctgctgctttcacagatctgacatgcacccattgcattgtgtgctacctctgcctaaaataatcctcccccgtttctccatgtggctcttttcgtttctgccttaacttctttactcaaaagtgtttttttcaatgaatctttctcatgtgtgcacatacaccacacacacacacacacacacacacacacactttttatccatgctttcctcatttatttttctcaataaagtgcatgaccaggaaagttctcaatattttccttctttatcttcttgagtatttatttccctacctagaagtagagctccaacccaacaatgcaaaaaaaaattgtctttttttcccactgctgtgtcctcaacacccaaaacagtgactaggtacacagtatatatttgtttaattcataaaataagtaattaatcaataatgaataaagcaattttaagattctcttagtgcttagaatgaaaacttgcaaaatttcttgtgcgtgttaagaattttatactaatcattaaatcgatagaagtatacaatttttgaatagtagagggaaaaataaagacaagctattaagttaaagcaaataatccaaatagaaaactgaggtttaagaacattaattgaattcatcaagggtagtaagaaactatatgaacataggattttgtgttttccgaatatctctagtccaaagccatcactatgtataaaataagatgttaattacagtttaatattcttgtaagtttaagcaaatttaccatttatacgtgatttatacaacatattacctcttgaatattgtctcaaatgactggcttcaagtagcacgttaaataaaaatagtagaataaatgtgtcaagctacacttactattcacaattattttatagttagattatggctctgttagatatacaattttatatttgcttatcttctgaattaatgttacagtaatagactacagtcatcatgcaatgtgttgtcaaatatattaataaacataagaaaaaacatagtaatatactgtgtcaaatttttctatcaagtggaaatttagcacattcttcaggaaatattgactgcaaaatctatgattaatatatttttcagaaatattggatataaatacaaaatgaagtgatgaattattgatatgtgcagttttactatcatataatgttactgataaaattaaaaaaatataactcatttttagcatcagatgaggaaacttggttcactaaagttagtattatctttatttgaatgctacaaccttgaaaaattattacatttgatagaactatttgggaacagtttgttacttctcattgtgactatggacattaatgggatgcccatattccttccattcccttttcttagcatagtggaaatgattacagatatcagttatgtttcttgactgatgttacagtcattccgcattatgaagtatgcaagactaaatttttacaaagggtatctcttatccttatgatagcctaaaaaggtgaaaatttgtcaagcaggtttcctaagatcctataaaattaggggacagggttccagcatcaagatgtagttttacttattgaattaacacagagttttgttgatgattttctttgatgatgggggtagtgatcgtggtattgttttattacattggtttcttcctttttttgttcatttttaatgggaacctcccaataatggtgaggatgcagttaaatggtaactccatacacttagtgtgagtctagaaataaattcaagttttattttgaatacactgaattggtatttctttcattgaataaacatttatctagtgcctcctaagtgccagacaacacaaaacgtaaaataccattggcaaatccatagcaatcatacaaaagacgtgatatttgataaatataactcatacaatgaagaaaaaaaagaacaagaatttatacacagcaatttgacctccgtttgcaacacaacaatataaagtgtaattttctccaatctaaatttgctttgaaaatatggaacaccagctggaagggagctcagatggcttctgcagtggggttggaaatatccttctgagcatgtccagaacaactggttaaaaataattaaatcacttgcaccatctgtgaatcattctgattcttcaatgattacttaagactctcattgtatggaacatattctgagaacagatgaataaaatctattcaagtgtatattgttttccactttgattttcacaaaataaaaggattataatattttcaagttggtaagttatctgataattctcctgccctcctttatgatccagttgcttttgaaataattaaggtttgtttaaaatttagttttatgaataatacaaattcacatagccttgatgttataacataattttgcttaaaaacattctatcatttttaccctttatttaatcttttgagtatagtttagcacccatttagtaacagccaagagaactaaatggaagtccgaattgattgcattctcaaatttagcaccatatgctataatcatgagcagtttttaaaattcctaaatagctattttaacgcatgtaaaacagaggaaagctatatttagtggtgactaatccatggatgaaagatgcatggattaaatataatccaagtgcccatatctgtacaaacttaagatgttcagataatttggaggcattgttaactgtttttctggatatcagtgcatgggcacttctcgccagaataaattaactggggaaagttccagaaggtccataattttccataataattagtgctttcttagttaatagactatctgggtgatgaaaaataaatgaattacctaacaaatacagttatctataacatataactccatctgtgacccgtataaagctcaaaatgtgttaactggttagtatctagacaatcataaacacacatgaaacatgaataatatcggtcactatattttcatttcttgcttcgtagatacactcgagtatttcatatgtggaaaattaagagatctagtcctcttcatatattggcctccctaatgggaaagggtctctttaatctgctacaaagccctcctcttctttaaacttgccaagatgtcttctacctcaggtcattgcaattatgtttcctttgacttgggcctctatttctggatatttccttgctggtctcccgtcacattgcaggatgcagagtgaacattatctccacaggtggcctgccttcgacaacctattttatgtcgttcgccacatccattctatccttaccatcatgctctagaacatcagctagacgtttcccttctaatatttactgcaatctgcaaatgttacctttgcatgtttacttgtttataatttgtctgctatcattagaatgtaggcttgatgaagtcaggagcctattctatcttgttagtcactgtttccccaagacatagagtctatcacagagcaggtatttaatgaaagtatgtggaatgaatgattgaatgaatgaatgtataacatcttcctgtggaaatccctgcagtttcagagttggttgttctgtatttttatgtcagtggtatcctaatgccagtctgccatggtccagaagttttcaatggtccataaggaaaagaaaaaaaagagcaattttttatttagcttttcataaagcaaagttttttaatgcaagaattgtcctttctttcaaaattatgggtttcaacagttttggaggtattaaaatggcctttctttttctttcttctcattttgttacaatgtcctttactagaaaaagtaaagggcagaacttttgtgatgttccctaatagttttttttttttgtaatgttgttattgacctatgaaatacaatgtccgtaaaccaccaacttagataaatttatttacatgaaggaataccattcctgctaagtttctatattggttgcttgaagtttcagaatgaggaagagaaagcatgaaaaccatcacctcctatatgtatggcctgttcggcaagcagtactggccccataacagttatccactggaataacattcttgaatttattttgtcacatgtgaggagcaaaaacaagacaaaatacacaaaaaagagtagaattagggtatcacgacatttgtctaacattgttcaacgttaacacttacaaataataaaggtaccaaaatggtattttcttgtgtataaatattttcatcctctggatttgaatctgtttttgtttgttttggtgatataaagaactcataatagtatcatttcctgatgatatttggaatccaaaaattaattcaaaacagaagtattacattttctgtccttttcataattgtaaacaatgcatcaagatcaaaaacttaacaaaatgcgttaatgttattatgcatgcttttttcacattctttatttcccagtgatcataatgactaataattaacataattatttgtgattgacaaaagactctaacgttcatcattttagttaattattatttaagaaataattggtctggatataatataagccaattaaatttgtattctgaaaagttttgagaagtgaaaaaaaatttattttttatttggtaaaatactttatttctgttgtagctgcttttacaaggagattgtggggaggaacagtcatatccaagttctcagttaattaccttttcaaaatatatgatctaaaatggagtgaaaattgattgtgtcaatatgagtttttagagttaaaacttgtaaattttctggacagaatagaacaattttatattggaatccttgccataggataatacaatgactattatttcctggaacattgacagagaacaagctattttaggagaaactatctggattgtaaagtagagcacattaagcctaaggtgtcattaaattcacaaaacttttaaaaaagaattgagcgtaatctttggtaagagaaaaatggttttcttcagtgactattaccatattttgcaaagttataacctggcaaaatatattattttgggaaaataatattaaatataaccatttctatacacacagtggcactttatttattcagaggtcagatggatatcattttaatttacctgcaacacagccaagagtcaggaatggagtagaacaaaaggcctctcgattcccaaaattgattttttaaggttcatgaaatccaaagcttacttatatttcattatgaaatgaatttccaaatccttttttggagattttttaaaaattttgctttgattaaagaggtaattctaataaacttaattatctctttttttttttgtgcccctagtagctttgaagtcaaaatgggacagaaggaataaatgactgaaacaggagataatagctgcagcctcgagtaaggtgaaaaagaacctatatatatggactcatagtttggggaaataatttagcacagggcaacacagatgagagagggagggatggaggaagggagacagagagagagaacagataattagtgtttatttcattttatacttatggataatttaattatttcaatagtttattcatatagttaggtaaatactttttttttttttttgagacagattctcaccctgtcacccaggctggagtgcagtggcatgatctcggctcactgcaccctctgtctcccaggttcaagtgattctcctgcctcaacctccagagttgctgggattacaggcaaccgccatcacgcctggctaatttttttatttttttagtacagacagggtttcaccatgttgtccaggcttgtcttgaactcctgacctcaaatgatctgcctgcctcggcctcccaaagtgctgggattactggtgtgagccatggcgcccagcccaaggatctttaatatcttacctatgtgcaaaagtgtttaatacataatgccatatggcatattagcttcctaaatcacataccactgccaccagctaacttatatctctatatttacatctgaggctgcataggcacacataaatgtattcatatatgttacacatatgcttatttatgtagctatgctatatgttatttgctatttacatctattaagttacttagcaaaatatgtcctttggctttgaaaaaaatgcctgctgaactcatcaagattatgatttttgtaggttattctccatcttttagtcgagttcctaaagttgtgtttttttaactgcctgctttttattgcaggtatatgaaattgttgtgcatatttcaaagaagaatagaatgcagggtaactctcaaacttgttatttggaattaggtcagataattttgtaaatactgttatcagtatatcacaatgtcattagtgtcccttcaagttaagggcatggaaataaagatggtctaatgtgccaggccaaagaggaaaacttttcagcttagcaaagtgacttcaaatacatggggagaattgaagcagtcatttcaaatgcaaacaaaaagttgtatttttatggattacaatatccttagctaaatgtttactttggcttgggtatttttctcattagtgatacttatttaattagttgcttataaattgaacctgggaagtgtagtttgcagtgagccgagatcaagccactgcactccagcctgggcaacagagcgagactccgtctcaaaaaaaaaaaaaaaaaaaattgagtacttaagatcaattaaaatatatcgagtattggatgctgtcacataagagtgctattagccattggctgttaaatttcctcatctccaggaatctcaggcacctaaaaataattctctttacttcatgggcaacagcagccactagtctttgccacgactcttctgtcaattgggtatgcagtgaggggcaccaatatggttttaggtgatgatgtgaaattgtttcaaaatgctttcattctcccttctgaattttgtcttagtctatgcttccataatattgggagccaattagtagtacatgccttcctgcagcttgaatagaagtgaagtctattatgaacaataaagtcaattagagggggccatgcctactgataaatatgttatgtaaagactcaatttaccttgaaatctgtatctatttgcatctactctttagtgctagttcagagctctgtgcgattattttaaatgtattgcagtattactttaatcaattaatacaaaggtagattaaggaaactttactactcttcatttcttcattctgctgattcctccctcactgaagcaaaaaaaaagtctacaatttagtctttaaaaagtctatagtttagtcttagatatctctttgtactatattccatatactgttcattcttaccaatgaatagtatatatagatatattttacttttttaaaaaatactgctttattctgtgtattattttaaatataacagtcaattagaaacatgttcccaggtaatgtatatagatcttatacattctttgtgaaagtcttagatgatgaatcaaaatgtattctattattcttctacatttctggattattatattttgattagaaaaggtggcctatcaaatctttctttttgatgcttttaaaagtttcctctctatgtaatttttgatgtcccaagtaaataggagaatatgctttttccagtgtgcacaaaatacggattaaatttagcttgtcggttttaaaccacctctattcttgttttttatttgtattttttgtctattttaatctaacaaattacagaagagttgtatgtaaggtaccaactacagctatgattttatcatgttctccttttatttctagtaatttttaccttatgtagaatgcacccaattgtttggggcatagcaattaatgactactgtgctttgggaagaagtgtgatttttgtcattacaatggttctctgagacccatttagtgcttttcggtcttgaactatacttcatttgatgctattattttgactttcactttttaaaaaatggttttctaaatcaccattaacgcagcattgtgaccttgtatttttatgtttcttgtgactttcactttttaaaaaatggttttctaaatcaccattaacgcagcattgtgaccttgtatttttatgtttcttgtaaacagcctatagatggagtgtgcattttaaactagataattttgtctttttaacttatgcaaatatttttacatctttatagggtacatgtaatattttgctacatgcatagaatgtataatgattaagtcaggatagttagggtatccatcatctcaagtatttatcatttatatgtgttggaaatagttcaactcctctcttctaggtattttgagagatacaatatattgttgattatagtcaccctactcttctttcaaacattagcacttactctttctatgcaactgtatgtccgtacccagtaaccaatctctcttcacccattccgcccacctacactcttcccagcctctggtatctataaaaaaaaatcacatattcttaccaatacgtgcttgatcttatgaagatataaaaatgatagatagttcatctttagatgagacattttaaccaacttcatttttacaataactcttataactgtgtctgttttaattccttgtcatattgatggtcattattttatcattttatttactcttatcccttgtctataattttataattcatcatcttcttcactgcactctactgcatctcttcccgcacttataggttatttataagttatactttgtactatcattttactagtgctgtttcccattttaaacaacaattttatgcctatatttctgtagtgttgcgccaaaattaaataagaacaatgccctcatcaccaagatgatttacttagtcaactcctcattattttcaatcaaaggcaaaatcctttaaaaagaaataatttataattttatttcctggctactattgttttcacttgtagtatcacatactagttcaagatgtcatgttattacttaaattacactatcacttcataaaatttgaccacaaacgacacaaggtgtatttcctgtcactgtttttttgtaccgtttatttctcattgttttgaaatctttattacacagtcatccttcagtgtctgtggggcactggtttcagcattttgatatcaaaattcaagaatactcaaattatttatataaaatggcatagtgtttgcatgtaactatggacaccctcctgaacacttcatatcatctctagattatttatagtacccaatacaatgtaaatgctatgtaaatagttgttatgcagtattgtttagggaataatggcaataaaaatgtctgtacatgttcagtgcagacacagccatccatgtatttttgcaaatgtgttcgatcgatgactggttaaatccacaaatgtggaacccatggatacagagggccaactgtacttcagttttaatttggttggaacacatgagaaatgtcctcgtaaaaacataaaggatgtaaactttgtaaaccttgcattttcgaaatgatctttgctttgcagtcatcatgatggatttattggatagtaacattctttaatatctctcctctttttttagtagtctctgtaggttatgaacaattgtcttccagtttccattgttttcttgtttcaactatcttcaagctactattgtttccagtgtaaagtctgattctagtccaagtatcatttatttgtatttaaccttttttctttctctcaaactctaaagttgctgtctgtcccatctattgaagtacagaaatttcattaagatataattttaaatgtttctaaatgtgtccctgtttattattttattttattttattttgtttttatttttgagacagggtcttgctattgcccaagctggagtgccgcgatgcaatcatagctcactgcagccaccaactcctaggctcaggagatcctattgcctcagcctctttagtggctgggactacaggccatcagtaccatgactggctaatttttaaaacatttgtttgtagagatgatgtgtcattatgttgcccaggctggtcttgaactcctggaatcaagtaatcttctcacctcagcctcctaaagtgctgggatttcagttgtgacccaccacttatttaattcttttttgcacttgggtaacgttttaaataaccaattaatattaataacttctttagctctggaaaattttctattatgattgttttaattattacaaatcttccatctcttcttttttctcattctggtacttatcattgcttaataggtatcttagatctgttctctaagtctcttattttttcactattaatgtcagtttatttctatttgtctttaaattgtgatatacttcttctggttgactgtaaagaacccatattttatttttagccatgatcattctcttttctaagttgtctattgttatttaaaaactaggtaacaggctttctgtgctctaatgttaaccttttaatgtttctaattttatttttattaaatgtaccttccgtatcttctagtatactacttgtatggactctcagctttgtctttctctccagccccttgtgtcttctgaaaaagcctttgctttattttctctcatgcctaagtcaaagaatgtaaaatgtcttggcgcaaatgcagttaaggttttgatattttgatgcatagtgattgattgagaagcaacatggatactggaagttttgttgttgttgttgttgttttgatctgatgaataattatttaacaagctgaaacctattcacaaaatttacatatgggaaaacatctctgatctcatggacaaggggtggaagtaaggctgtcctcaaccatgtagtacagccactctccagtaatgcctgcatgaaacaaactagcaggtactgacccccttcttaagtcaaacagatctccttaaatcaatggtctccaacagatcattccacatatatacttgaaaaccatcagatccatcatttctgtctcagatcgtgccaagatacacataactttgaaatatcaccagttcatcatcattctctcttcacctgcaatttttttttccataatttgaggtcctgatacatatattcttctaaattgtagcagttagttgtgattatcttgacgttgcatggactcagttcaaagtgaaacagaaaacatatctacgatgtgatttacccattctcaacatttctattttgtgtgtctgtatttgcacagacacgtacatacatacatgtgcatatatataattaataagctttgaccatataaataatgcaaattatgtataattcacaataataggtttttaaattaattatcttcagagttgagtgagattacttacagatttaggctgtgtctacctgaaaacaaaatacagtgtattagcaattcagtaaaatcaattggatatagaataataacaaattagttgagttttcaccttgtgacattttagtttggatttagtagcctgtctaaattacctttgtgaaaaaactaggctacaagtattttctgatagatataataccagcattagaattattcatataatcttagttttcacattatttaaaatagaacacattgttatattttaataagcaatttgaaaaagaaacaaatctttctttcttgtatgattgccattataaaagaatattaattgagtgctcattaggtaactttaaccacattaagtactagacagccctttggacagagactgagtagaataaaaaacgattacagaacatactttggtattaaccttttctataaataaaatgtattgtcattctctagattagcactgtcctatagaactttctgagatgatggcaatgttctatatctacactgtccaataaagtagctattgaggctactgagaacttaaaacatggctagtaaaaacagatgtactaagtttttaattgtatttgcttttaaataatttagatttacatttctttcgtcaagtgtagctaatgactaccatacgggatagtgtaattatatgcatctttactatcactcgcatttctaatgaagagaatacttccttgaaaaacataattatgacacatgcatatttagacatagatactgagttgccgcattaatctagagatagtgtccacattttctgaggggtgtgacaaatgtaatatagaaataaaagtgtgagtttattctgaaaaatctactcaagttgacagatccacaaggcaacagaagttaaaagcgatataggagggtgaaatataactgcagtatttaaggtctttccatacttattttttcttgtgttacttttattttcacactgaattaagtataagtatgtgtgtgaggtggagggagggttcgatttgcttgtcaacatacaaaaagattgctatagcaagtattcccaagctgaaattttggaatagcttaaaataaaaaatatatactagatatgtaaacgaaaacttttatgagaagagtttgggaagagttatcaaaggttaaaatgattttttgaatacaagtcttctcatacccttcaatttgctaatagacattatgatacccatgaagaagctaaaatcagtatatcttaatatcgtctatatgtcattacctcaaataattgcttatgtttgtattcaagtataatgagtcagattagtaactaaaagacaatttaaggacctaagcacgcatgtacaatagcatgtagctaatgtgctatgaattgaagaaatgcgacatagtgaaatcagatataccttttaaatctatgacaataaagattgcattataaaatgaagaaaatattcctgtttgaattctgaatattcctaaatataaattataaatgtaaatcccagcaattgtaaccacatatctatcttataattatcctgttaagttgatacttgttttttcattaatttatccaacaaatatttttgataacatactgtatgctaggtactaggcatgagtctttgctgcatttattttttgctgccttataagttggctagggtgtataaccttatctattaatttataggttattttttggagatggttttacaaagcaggccatgattgttggtgcttatatattgctgcttatgtgttgatacttatcttggtggcaaccaaagcccttttctttctcttctctcacaggccatacttagtgactaaaattttatcaagttactaatttatgttaattctttgaaaatctgtataaaaatgcaaatgttgtcctttgaaacgaaagactttaaaccactataagccattaacacattttccagattcagtttatcagcttaatttgatagtaattgagcttggccctgaggaattaggtaaatttcatggtgtagaaagtcagaatccacatgaggcaggtcaatgagcaggtctgtccagaccttttacataggacactatttatacctggccttctagaagcagggtgtatttaaagactggcaaatccagcatcatctgcatatctttttcgctgacagcctgccctgctttaaaaattaattctaactttagaaaataaataatatgggcataaaggatgattttctttcatattttaccttgactattttgtgtatgttagtgagttttattctttttaaacaaagggggtaaattgttcattgattctgaataattattctgagatggacaggccctttttttggttacatagcttcacataagcaattttttagatgatgcaataggaagggggaaatcacataagagcaaacactctctcattgctattttttctatgcacggtcataaccaatatgcttagactcattagattgattattcaacatctttctacccagtgacttgactaaaacagacaaaacgaagtactgtcagaatgctgttattgtcatgccattatatgtatccaaaacagtgacaacgcagattaaaaccatacccgtctcacctgcatcatgttgttttgtttttatgctttattgtttggggttttttaatcaccctggaccaatacaatatttttgcctaatttgtttgtgatttgcatttttatgcttacaatgcctattataattgtccaggagaaataaataaaaaatctctcaactttgtttattactgtaatgattcctagaaggaaacttgtctttctctgaagacttgtggggctaagagacagagctacttgtctaagacttaagtctttcccattgccttttcatttatgacccatcagaacctacttaaagcctgcagtcctattttggatttacatatcattgtgttattacttttaaataatccataatatttaagaatgtccctttgaggaaagataatcagatacaaactgacatactttcatattatggctcatagattttcatattatagctcacactaaatcattaataaatcttactttgaggatttgcttattttcatcttcattaacaccaacgcagttaaaaaaaaaaaggctccatcactattttactgtttttggtcaagataatagtctatttttgttacacttttgatgcattgatatatttttcatgtgccatatttatatgagatatatagttattttgtggcatatgtcataatcatatgtcatatagcacatttttcttcttgagtttctttgacctcataactcataaatgggccagtaacctcaatgcatttaaaggagaaagaagtcttttaaatcatggaggaaaacattttgtttaaaaacctagacataatgcaccatttgtttcaaaacaggattgcttttatcctttgcagttatggcccttcaagaaacaaattttatgtaatgaaaagaatgtgataacttaagtttcagatgaatgaaaatgtattcaaaactttgtgagtgatacctgtgcctatttacacagctcagaatcttaaaactgttttgactttaagtttagatcatacaaatcataattgtgttctataatagtcattaagcattgatcgaacttttcatttttaaataaaaataggcattttatggtttctttcacatatctttttgtttctagaaaatgaggctagtatattctttggggtatatatggttaaaaatgaaaataaacacaaagaaataaaatgaattaatcagattatagcatttccttgctaatgatgcatgagtatctataatgatataaggtggtaaagaacattaacaaaagcaagttgattttcaaaaggttagacgggatttgtacacatcagaactcagaaggataaaattattcaaggcagagttaatgaaattcaaatgaaaaggattaatctgaatgagtacctggattttgcataaagaagagaaaatgaacatgatatttctaattacactgatttttaaataactgtctgaaatttttattaaaccaaactgaaagtcattcaatggatgtagttttctcattatagattcgcatgactgtgtcaataggaatgctatacttttaaggaatagatagcaaactagatctccaaatgtctggttctcttttgattcaatttctggtagtttcttgtatatgaaaattacaaaaaagtctatatattaaacattattgtatatatcagattgctataataaatgagaatattcaaacttaataacacggaattttctagaaaatgagttcacagtttcccagtggtgtcaaaaagttattttggaatatttctatttctcaagaaagttcacaggatcaacccttagttttctctagtcagctgatctgtaccacttagtgtctgttatctgtgatgactggacactacgtatcaagatagtaaatctttcaatagatccgtcttcattaaatatatttaaagtataacattaaccttttagactttataacgtatagctgaactgttgcccataggtaattgtaatgagaagcatcttagaaattacaggtattctaatttatctttataatggaaagaaaaatttttgaaagattacttaattatcagtagttgaggatagaaatgatttttctcattcagatttttctaaagtaataaactatacctttttattgattatgttcaaccataagaattttaatatttctaagtgttctagaaaatgtgttcatgccatggctgagcatgtagggattatttccatgtattgacactggttgctctatggcttatttgtgacaatcttgaaaataatcacaatatgcatattattagagcattctcaacctgcagttcaatggctaatatttcttttaagagtatttcgatcaggttaataagagcttcttcattatttaaaagtttgtaaaaaatgatttctagaaccagatacagaattacaattatttgtcacttaggtatctaaaattttcttaaaaattgaactcttgtacagagagtaaaaggatgattaccagaaaaattggcaatttaaatagatgccacataacactcttctaaaagagattttctttgaaagataggtgaaaatggtttttagtttaatgttctgaagaatatttgttaaatcggtatataataatctatggtagacacatggggtcaggtggagagaagcttaacagatgagaagccagggtatggtgtgctgcctacattctttaagccctggtttaggactatgattaacactggatcttatttgctgagacacagaattctggtctgagagcacgaattattattttctaagtgaatctaatttttattttatccagtgtcactgaatgattttttctttttttttttaattatacttaagttctgggatacatgtacagaacgtgcaggtttgttgcataggtatacatgttccgtggtggtttgctgcacccatcaacctgtcatctacattaggtatttctcctaatgctatccctccccttgccccccacccgccaacaggcccctgcggccatatgttttcattgttcaactcccattatcagtgagaacatgcagtgtttggttttctgttcctgtgttagtttgctgagaatgacggtttctagtttcatccatgttcctgcaaaggacacgaactcattcttttttatggctgcatagtgtcccatggtgtatatgtgtcaattttctttatccagtctatcactggtgggcatttgggttggttgcaattctttgctattgtgaacagtgctgcaataaacatacgtgtgcatgtgtctttatagtaggatgatttataatcctttgggtatatatccagtaatgggattgctgggtcaaatggtatttctggttctagatccttgaggaatctgcacactgtcttccacaatggtggaactaatttacactcccaccaacagtgtaaaagagttcctatttctccacatcttctccagcatcagttgtttcctgactttttaatgatcgccattctaactggtgtgagatgctatctcgttgtggttttgacttgcatttctctaatgaccagtgatgatgaggtttttttcttatgtttgttggccgcgtaaatgtcttcttttgcgaagtgtctgttcatatcctttgcccactttctgatggggtcttttttttcttgtaaatttgtttaagttccttatagattctggataatagccctttgtcagatggatagattgcaaaagttttctctcattctgtaggttgcctgttgactctcatgatagggtcttttgctgtgctcttcagtttaattagatcccatttgtcaattttggcttttgttgctgttgcttttggtgttttagtcatgaagtctttgcccatgcctgtatcctgaatggtattgcctaggttttcttctagagtttttatggtttcaggtcttaggtttaagtctttaatccatcatgagttaatttttgtataaggtgtaagaaaggggtctagtttccgttttctgcatatggccagccagttttcccgacaccatttattaaatagggaatcttttccacattgcttgtttttgtcaggtttgtcaaagatcagatggttgtagatgtgtggtgatatttctgaggcctctgttctgttccgttggtctatatatctgttttgctatcagtataatctgttttggttactgtagcattatagtatagtttgaagtcaggtagcgtgatgcctccagctttgttattcttgcttaggattttcttggctatatgggcccttttttggttccatatgaaatgtaaagtagtttgttctaattctgtgaagaaagtcaatggtagcttgatgggagtagcattgaatctataaattactttgggcgctatggccattttcatgttattgattcttcctttccataagcatggaatgtttttccatttgtttgggtcctctcttatttccttgagcagtggtttgtagttctccttgaagaggcccttcacatcccttgcaagttgtattcctaggtattttattctctttgtagcaatttttaatgggagttctctcattatttggctctctgtctgttattggtttataggaatgcttgtgatttttgcacgttgattttgtatcctgagactttgctgaagttgcttatcagcttaaagagtttttgggctgagacgatggggttttctaaatatacaatcatgtcatctgcaaacagagataatttgacttcctctcttcctatttgaatatctttctttctttctcttgcctgattgccctggccaggacttccaatactatgttgaataggagtggtgagagagggcatccttgtcttgtgccagttttcaaagggaatgcttctagcttttgcccattcagtatgatactggctgtgggtttgtcataaatagctcttaatattttgagatttgtcccatcaataactagtttattgagtgtttttaacatgaaagggtgttgaatttatccaagaccttttctgcatctattgagataatcatgtggtttttttggtcattggttctgtttatgtgatgggttacatttattgatttgcgtatgttgaaccagctttgcatcccagggatgaagcctacttgattgtgatggatatgctttttaatgtgctactggatttggtttgccagtattttattgaggattttcttttttgttgtgtctttgccaggttttggtatcaggatgctgctggcctcataaaaagagttagggaagaatttattttcttttgtattgcttggaatagttttagagggaatggtaccagctcctctttgtatctctggtagaattcagctgtgaatccgtctggtcctgggcttttttttttttttttttttttggttcgtaggctattactgcctcaatttcagaacttgttattggtctattcagggattcaacttcttcctggtttagtcttgggagggtgtatgtgtccaggaatttatccattttttctagattttctagtttatttgcgtagaggtgttgatagtattctctgatggtagtttgtatttctgtgggatcggtggtgatatcccctttatcattttttattgtgcctctttgattcttttctcttttcttctttattagtctggctagtggtctatctattttgttaatcttttcaaaagaccagctcctggattcattggcaaatctcatttttatttaacgttcctttctgcaaataccaaaatagtcaaaatttgggtttgaaatttcatttaaggaagttaaatacaagttagcagacaaaagtgagtatattttgagtgtctttttcttcattatatttgaccatacagctaagtttcttgctggctataatccacaattactatatttattaagcaccaatatgaatttaagatagctgagagcatctcaaatgaaagtaatgaagactgagaaaactacatatcaaagaagaatcagaaaatagataaaaacatcttagaattatttttcttttaagaaaaagtgatgaggacatgcatcaaaacttttctgaattcccactgcttttgttaaggccacccagatttttttctaaatattttcaagatatgtccaattctgaaacaactcccttgattaaacaacaaaacaaattaataaataaatgaaaaactacaacttgtcttctacttactctgttcctgataacaaaaacctttgttttccaaaaacttacaggtgtaaaatgtatcattaaaggcagatttaattgcaccattaaataagtattataagaaatacgcttgctttagatgatgtgaagctatctttactgcaggggttatagcaactaacgtgaataagaaagacgagcttattaacttgtaaattttattaagaacaacataatggtcaccaaccaatgtaatgcgtgcaaaacacaagcttgtgttacttgtgctattgattctactgtttaatgtgtcagtgaaaatttcacattcaaatagcctgctgagttatttttcttttaaatgtgtaaaatgcttatgatgaaatagtgaaattaagaatttcttaagaaatctgttaaattctgaattttatttatcaaactctggctcaagtttctaatatccttttaaatgtaaatgagaaatatatatacattattccattgaacatgaaggaatgtgtgccatggatttggcccagatatacacaataaaacaaatgttgtaaaaggtataattatttaatagctaatttgtgcaattctgtgaatttgctatatcacaagtagatgagatatctaaattagaattacttcattttttatatcatgtaagaattgagtatgaaaatcctaggtcagagaaattaaaaacaaaacataaagtgaccagcttgtaaattttactcctctttgtgtggggttcagtctagtatccccaaagtccaatgtattacattactgcaaaaataagtatggtgttgtcataaaaggctgtgcagtaataaatggctacgttagcatgcttatcgtttgtacttccccagagaccctaccactgaaaccctcaggtgacctcatcaacaggcaggtggcagttgatcaattctagacaaagttattgggagaataatttcaattacaagaattttgctgcctatagtgtagacagaagagagcacaggtcatccatctttctgaatttgcctgccaagtagtatttattttttgctcttataaagaatagggaaagatgtattactgggaaactccaaaaggactctggagctggaaattctcatcatgtctagcacttggatcccagtcagaaaagtgtaggtgcaagagaagaggctagtgctcccttatatatcaggacattctggagttctttttaaaatataaattccgcagtcagttctgctcatatagcagcttcattagcagcttaacttagcaagagactagcaacaaaaacaggagctaatgtctagaatttggaggagaagagggcttaatacaaagttacataccagcctaactacttcgtatctgttgtatctcagtgaactttcctatagatacaggaaagttgcctgtgttaggaataaaacagatatgagtccccctcacccaatcccatatctagatttccaggaaaattagaattttaaatgccagttgcaaattagaattagaaatttaaatgccggttgcaaaaatcgtctttttcttaggataaaactactctccttatgacctcatggtctttcgtcttatatttatggtgctaatatgtgtgtgtcacttattatgaaatgcttttaacactttctggaaaaagtaggtatataattaataaatcaccgttttactagacttaccatcgtgaggttttgaatccattttcagcccagtttgtagattcaattgtcagctgtagaatgagacctatataaacttaatggaggaggtttcactgttaggaagctaaaaaaaattgttcttttgtatatctataccagcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaaggtaaaaccaaagcactttcattcgtattttacaaggtgatcatactgatcattcatagtgccagaacaattgacttaaattgtatgcatcatgatggcattttgactttcacatggaattcttaaaaatacttgatagtgtggttggcttcagaaatctagggtagaaagacataagttagaaaatgtattttacaatatttagctttgagagacatcctaaaatgaagaaatgcacaaaaatgatcatttttacatgcagtagggacagaaaggaaccaccagtaaataaactttgatggaagaacagtttattcctagttaatggatgacttctgtttcattttccaaaaagggaaattagatttttcatttatatgtaatgtatattgtttttgttttatattttttatgtatacatattcaatttcaaattaatgtcaatacctgtgctataacatatggaataaaattgaatagaaatcaataaaatattttctttataactgccagttaaaggctaccaacaaaatccagctgttttcaaaccaccaacagcaagttactaaattctcaagtaaggcaaataatgatgatgaaataggctatgaatttcagaaggcagtgtctgaagataaatgaatgtaggatcaagaaaatgcacataataatgtgtctccagataattttcatgatcgtacattttacactcaaaatgaaatattatagtatacccagagcttggtattttcaaatgcaaacagtatgtgattataggcaaaagatgggtttgctatcagcagcacatattagctaaagtattttatactcaaatggtttcctggaagctcattctatatcacacatttgcctgtatgaatatacaaatggataaagctatttgtttgttttggaaatcggtgttgcagtatcttcagtgacttgactttaatatcttaacattatatcaaataagctataaaattacacagtaaaataagagcttcacagatctctggaactattccatccatgtcagtgtggcactgtttcttattctgtttgaagtaaaagtcaaatcacttattggtacaatgaagaaaagaaacctaatcagttaataaaataaagctgacatgccagaattcctgtcattatttctattaactaagttctcatggcagcatagtttgtaagtgcatcattgtcattcaataagtaaattattgccaatgagctaatatccattccttcccaggttcatggacatttggttcaggagagtagtgaccctgatcttattaagttgcccattgaataactctgtctccatacctcttagcctggcatactcagaatgttagacccttggctacactcacagtgaatcatttgttcatcctgatctatttaatattattatagctgatgtcaatcgtaatagtattgattactgcggtttataatatggtattattgtagatttaatttagctaaatggttgaatccccataagatacagttgtgggcatgattccttctgtctcccaacaaatctccagcaggtgaatgggcttcctaccttcattgacttttttgaagggggatagttttgagctcagtcttttcagtgaatatgtatttcctgttaaaggcattcatcattgtcattatccagtagtaaaaatggaaaagcagtgcataaattgtacagctgctggttgggaaggtttgaaattgtggttgattttattcctgacagatatgcatgaatcaaattacagaactatagtaagtattgctgtgctttaacatacatcttttttgaaagtgcagtacaacacaaataatatgtaatatgttaaaagaattactttctaaacaaaatacaactaaaatagcacgtatggtttcaatagatgtattgaattggaaagctacctaatcatgttgacagagactatgcagataaacacaaacatatatatatacgtatatatatatacatatgtggaaatctgcatttaatagcaaaaacactagctaaggcagagctagagaagaatgagaaacatacacataagtaatattttctttcttacttcagagccaatattaacagttaattgattgtgattgcttatatgtacaaagttaataatactcataacagacaagagtacataattttagaagaattgcaattttttggaagtttagagcaatattaacttgcatttcatttttaagaaaaaatcattttcatgataaaattttccaaaatataattactgtgttaaaccgtcaaatcctgccttaaagtatctcatatgaaagcatgaacacagaatttcttagcatcgtaagttttaaattaccaaaaggttttctctggagagagttaaatatttgaaagcttatcctaaaagcagaaatgatccacttaaaagacttaactgaaaggatttatcatcatgtgtccatatgcctaattttactgaaagcatcagttttattggaggatgaaacactcttgggatgtcacccatatcatttcctgactcagcatgccttgtactctgactggtagctgccagatccaagtgtctctgactgtttgccttagggctctctctagtaatcaaagctcatgagtgtcaggtagttaaagttctgcatcccccgtgttccccagcaaacctcaaccaataacaaataacttttggtggataaataccactactcactcattcttcagttagggtaactctgaagcatgatttatgctctgacccaaaattctgttccaggattaagaccccatcgcacacagtaaaaacctgcctcataggatacatttcacttgctccctgtcctaccttacacacactttactagcacctccttggatcattcccaaagacatcccttgtcttcgaatctgcttataggggaactctatctaggacatttttgaaataaataatgacatatttactgtgtagttagcatttacgtagagaaattcttagaaatagttcatgcctttggagtggaattcttcaagtgattctgctgctccctcattcagggaatccttagctgttcaattaggccttggtatcaataaatgtgaatttttaggacaaaaataagaacatagcttataataagaatgacaactatgctttaccttttgcaataatgagaatcaatttacagctaatattattctttatggtagagcagaatgtcttcacctgaagaacatgaacaagacaaggatatctgcccacatcccttcaatattccacattgcactggagtttcaaatcactgaaaggaggaggaaggaagggaggaagtaaggaagaaagagagtgagggaaggagggagggagaattgaagaaaagaaataaaataaggagagaaacaaggaggaaataaatggaaggaaagaaaaaatatcaggcacacatcatttcagttgtctcatcaaaaccaattatagtacagatgccttgtttggaatgaataaaatgtgctatactttgggtaaccaagagggtgatgaaaaacgtggccatatgaagaaagctcacgggtaggagacatggtggtcctaatgtagattttaaataggatcaagaaatagagacaacccttgttcaagttcgagaccacaagggaaagctggtagtgagcttataagccaaagatagtgtgaagccaggtcgttcaagtcctcttgagttcaggttttttgcattgctcttgagaaacaaaaaattgttaggacaagtaaacctaaggaatgtggattcgtatattccaaaaatagttattaagctcttagtatgtaccacacactattctaagtgcttataaaacagtgaaaaagactaacgaatctttgccctcattcagcttttattataacattgggagacagaatagaagcaagcaaacaaagaaaaatgataagtaaatattgcgtattactaggtgatacgtattttgggaaaaaaaaaaaaaccagaatctgttaaggggatataggaccactacaggggtagacgtaggtataattgaaagtggcggaattgccatttcaaatagggtagaaatgacctttgagcaaagattggaagaaggtaagggagtcagccatggagtctgtgtagaggaaatagagtagaggcccaaatgtgggactgagcttatcttaatcaagcaccaacaagaaggccaaagtggctgaagcaaaacaagccagtggaagggtagaaagagatgaggatatgggagttgtgagtgtccagattgtggagggcctttggggccattgtaaagaagattctaaatgagatgagagcaattgtaagtttctgagcagttgagtggcatgatctcaatcatgttttaaaaggatcacactggcttctgggttgagagtagaactgtaggggaccaataatagaatcaacaagagttgaaaaagagatgctggtggcttggacttggtcggtagtgagagaatgtcagattctggaaatattttgaaattagagatagcagatatatttctctggtcatacagaaacttaagcatgtgtctatgaaaacccattctcggccgacttggggctgagttagaactttggtctcgtaaaacctagcagaagatcccttgagagatgtatgatttcttctcatattttagtcttcgattcttcagtcttgccttgaagtagggacaaaagtactggcaacagagatttttaatacactggttaagatctttctcctctggaatctgtttcacagctcttaagcacaaatttaataatcccaattagttaaatgaaggcaaaattatgccatgagcaaagtgactgcttttctattctggtattaggagaattagataatagcaagaggcaccatatgtagaaatccaaacaaaatatctgaaggaaaataaaagaacgattgtttatatgcgtattgtaatacaggggcatattacattgtttatatgcatattgtaatacaggggtatttaataatattggaataagaggacattgcaattactctaaataatcatggatcatataaaatttcaaagcaaaatttgtttgcaaatgctttttgaattcgagttgaattttctaatagtttaatagttctaacagtttaatgcgtggaaaagatgatttttattaatacattgtgactttgtagaaactgatcttttgaactatacataaacatttgcaataatgtgatcagtggtttctcttagaaaaattgagtttttcaacacatttatttggttataaatataatttgtttcttcaacagcttatatgacttgggatttatttgattgatttgctatatataaatgtgtgtattttcaaatattaatcattaactgtagtttaaatcatgcttaaattatttccatagtacattatttttcatttgtattatatgaaaagatttgtactatagagaagagattatagatatttactgcctttcagtcatgcccagctcatatttatatgtgcttcggtacagttttcttttatattttatacaaatctctcttgtaggaaattatccattctttatccccaaccattattttatcaagcctagcagttgtcctaccttgactattatgctgcaatttactcccaactctgctaaaatgtactttaagaacgcactcctactccttccattctcccagcagcactgttttcataatccccatcgtgtaaagtgtagaaagcagaaacttccatattaaaacttacaaatcatgaggctggtagaaattttgaagttgcagttaagttgtggggaggttttccttttattcacaaacggttgaagctgtgcttcgaccagttataatgtcgttttttatgtgtgatatataattactgattcgttatttatgcaaagacaatgcatcatcctatgaagaatattttggtccaaatacgtagctgtgtttagaaagtgttttctcacatggggacaataaaccatgaagaaaaaattaaaaggtcaccttaccatagagccaccaaaaataactttttaactttttttggaagctccgtaaaacctagttaataagtactttaatgccttttgattgaacacagttcccaattcgatatgtcattaatgtagtgcctggtagctggatgggatgtgaagagtgtaagaattagatttatatagggtgttgcctttatctgtcagataaagacaaattccagagagtgaaaatgaactggagtttgagtctttggttctcttatttctctttttccattttaagatagatctactccccaacggccgctgtcacaacagttactaatgggtttttctaatccttttttcttagaaatgaaagttatgtgctcctctgttaaccaagttacaaagtgtctcaaggcatttctgatacctaaaactgcttaaagctattattttcaccttcccaaaatatgacgacaatagtgcctagagttttataagtctataaacactatacatgcatttaagtatatgtataacccatgtaactgcagtgctacatttttcaagaaggtgatacatacacacagccaccaggaagaaaaattagtatcttgtttgttgtttttttcctccaccactgtatctagaactcctagaacagcacctagcacttaaaggtactgaatgtacatctgttgaattagtgagtgatggtctgatacatgtaggtgtggactctgagatagaagaagacagggcagtgttagtaagcgctggtactaaaagagaaaaccaaatttacttctttttatattgtatcctaactcactgagttaaatcatctagacatgtgcattctacaaatctatatgcatataagcatgaagaaattgttctaggtttgtatatactgaatctaaaacaatcatttatgaaaatgtgtgacagggaacccacatataattaaaacattactaacatttttccacatcagtgagctttcattatgtggttatgataagcagtagagtagagagtttagcaaagtactgtattggaacctgaaaagcttagaaagatttaacctgattgttgatagttgtacccttgggcaagtaacataagatatttaggcctgttttttaacgttgaaattaaatcagtgataataactgcccctgcctactcaactgtactcttgtgaagatacagtgaaatcatgtacgactgtgtaggaaaattcctgttaaaatgtataattatataaatttcaagatttgtaaaatgcatattgcttcatcaaacatcccaaattctaagaaagttataaatttccacgtaaagtatcctaaaaacaaattacctttaagaatgtgttaaacattataaaattgcatatttatatcttaaaaaactgtaaataaaatgttaaccacataaaatatacgtaaagttatttccagatgtggcaaatattctaaagctaaaaaaactttaaaataagagaatacatacaagctaagccacgtttgcttttgacaaaatcttccttagaggatcttacaaacttttgatcatattcttctattgtacagaatgttccttgacttgtgatggggttatatccagataaacccattgtaagttgagaattttgtatgcggaaatgcattcaatacacttaacccaccaaatatcatggtttagcctagcttaccttaaacatgctctgaacacctatgttaacctacagttgcgcaaagtcatagaacacaagacctattttatagtaaagtgttgaatatctcattcaatttagtgaatactatactgaagtatggtttcgaatgaatgtatatcactttctcaccaccctaaagttgaaaaatcactaagtagaaacattataagacgggggccatgtgtatttccgaggctagttgttacttattcaggagtaatttttttattcttctatttatttaaggtataaaacaaataactcactttattgtatatttatcttgaggtgcagaaatgcaactctaaattattccaagattctgtgtaccataacttttaccaagaagaggatgctgttttctagcttggttttaattgttgttttattttgggctttagtttctttatgaaatgtgttgatttattttttccatttctagttcagtaacttaaaacccattgttctaattgtgagttcagaaccatgacaaaaattattgaaaaatattgaaactctaagcaaagaatgatttaatcagtagtgtttttttctcttttttgctttggagtcttgaaatttgcttttgttgtttattttttgttgtctttcctttgccatttaaaaaagttagtttgtatttattttctcctggttaaatttgtaaccatgaacatattaaaattataatgctattccattgaaccttatgaattgtcaagtctttcaaaaggtttaaatattggcaatatcttatagtttaatacaatgacttgtacccaagtctgcttatttctgaatattaatatatatcattaaacatcctgatggaaaaaaaacaagaactttctgttgtaaatcacgtatgattaacagacaccaattcccaaatttaatttgccaaaccacaggcaaaaattaaatagtgttatcagtaaggaaatctatggagcttccaaaaaggtaaacattgagtagagtgttagcttcctgctcccatatcatgccttttgtttatttcttttctttcttttttttttttttttagatgtatgcatttgggtacagaacaattgtatgaaagagcgattttgcttttctgtcccctgtgtaaaacaatatgatggaaagcacatttccccaacatcagaagtattagttatatataaaacgggcataatattaccaaatatgttttctgttttaccaaaatagtttactgtcatcaatattaatttttgcaggtttgattatattttatcatgtatggtagctacctatgaagttgcttaatcatttatactaaattttcatttatcaaaataataagatgctcatgattgcatatgtaaatagaattaaaaagtataacatgaattttaaaaaagcatattccattcattggtgatcatcagtttttgaggttttcttggattgttgtattgctttggaatttttcctccataaaacctacctggccctcctctgctgagtcacacaacactaaagcgtatcctgactctaagaaatttgggatcatagaatgccatatattttgaactaagagaaaagtacttacttctataaaaccccctttgccatgcatgtgagtcaatttttctatttggattttctgtaaaatgatttaggcgatgtgtacaacttaacacaaaatgtacgtatcataaaaggactggtaaaattgttttcaatttacttagtgctgatggactagaatcattttatctgagaaacacttggatcagtaaagtgcagggttttttttgttgttctttttgttcttgttgatgctctgtggcatctggagaaatgggcaggtgtaattctgaataaaggacttttttcttagatatctaatgtgctgtgaggaaaccataaggaaactcagccaggaaatgcatgtggacttctattccactgttcaacagctaatgtcttgtaaaagtaaagtagaataaacaaggaattacctgaatagctcacgtctgaccatacctgaatatctatctacaatggttgaacagagtaacaaatcttagaggttcaatgattgaattcaaattggattttcataagcaagttcaactcaactttttacttcaagtcaacagatatttattaatgctacaagtgctatgcttaacattctaaaagataagaaagaaatattaaggaataatccttgtactctggtagttgataacattattgaatatacatattatagttatacaaacaagttagagagtaataaagacattaaggacatcatccaagcaaaaatatataagacatgagtgtaactgaaatcatgaaaagaagaaagcagcacaaaaagcagaaactaggaggaattttatagaggaggaatccttagcttgaggtgtgaatataactggaatctggactaatcttgaatgtaatagctgacagttattatttttgtgccaggacacattctaaacacttagagtaacttgtatggtcatcataacagccctacaaggaaggctgtattattatacccatactcagatggagaaacggaggtcctgagcagttaagtgacttgctcaggtgagatcatttttaaatatcatagttgaagtcccactctggatgttcaagctccagagtttctgctcttaagcactacgctatacagtttcttgatgcagaaaatgttttcaaagttaaagatacaaagtcagtaagggtaaaaaaaaaaaaaattgtatcagaaggatgtgtctgaagaataacaaagagattaatccttcactttgttattcactttgattatcctttcaagtgtctctgctggcaaagcactaggaaatcaagttggataaaaactgtgaatccagttttttcttttttttcctggaaaaaaagatgggctaaaagatgggcttgaaagtgtccaaaaagctatatgtcatcatggatggattttggtcagggataatccttaaaatggcaggataaattggacacaaggaaaaataaagagataaaacaataagtaaggagatatttgtgttcagcatagctggaccgatttataaaccatacccttgattcagtagctgtaccaggactctcattattaaagttcactcaggagatgcccaacatcctagatcacccattttcctgtgttagtgcaaaatgtggactggatttcccgatacatatttctatctagttaaataaatactctgattggttaaggaaaggttttctggaaggtgtatataatcccaccatggcaacagaaccaagagtctctgactgtctaccaacctgtagacttgaattttttccctgtactttcttctagcttcttcgatttctgttatccccaaaacaccttgatgtagccttaagcagaatcaaccatcaaagggctaactccctcctcctgctgggtgccttctctgttgggccccagcagcagtgaatctatgctcccaacttgacatttttcttatcccctttcccacctcccctaaataaaattcctttgtgtcaaagtttgatttaagtgatagaaatggctaagattgtctacagggttgggtttggaagaaaagaggtctggaaagggaatatagcaaaacatcagtattttctgagcaagtttggaagagattaaaaattacccctagtgactctcaaatttatatctctagtcaagattcctctcctgaatcatgacatatatatatatgccttttatatattcacttagaagtataataaacatcttaaatttagcatgttaaaatcttacaccctaaccttatcctcctgcagttttctacactatagttaatggcaactccattattccacttgtctgtgccaaaattcttcatgttatccttaaggcctttctctaccaacacacatgtaattggccaccaaatcctaaggattctgcctttacaatgtatccggaattcaaccctgcctccactctgatccaaagcaccatcatctccagcatggatgattgcagttgtctattaacaagtttccccctcattgccttctcccctgtagactctactgtcaatatactagccagagatacctatttaaatggaaagtcagattatatccccctttctgcttctgttcaaaacccccaatgctccccatccccctcaaagtaaacagggaagtccttatgttcataagtaccttcatgggttacccaccccattctctgatatttctctggtagtcgctagctcatacactccagccataatcacttcctccatgttccttggccactcctccaggcacattccagtgtcagggcccttatacttgctttacctgtctggaatattattctcatgatttttctttcaatggttaatttctgcatttccttcagatctttacttaaaaactgccttcctggtaaggtcttccccgacccctcttacctaaaattctgacccccactttatccttcatttcttccttccctgctttagttttgctcctcagcacttaaccactatctaactgagtatatagtttagtcatttctctatttgtttactttattctcctgtagaaggtgagattccagagagcggggcttttgctttctggatcactagtatatacccaagatataatatatgactgtctcaggctgggcgcggtggctcacgcctgtaatcccagcactttgggaggccaaggcgggtgaccacagggtcaggagttcaataccagcctggccaacgtaatggaacccgatctctactaaaaatacaaaaaattagccgggcatggtggcgggcgcctgtaatcccagctactcgggaggctgaggcaggagaattgcttgaacctgggaggtggaggttgcagtgaacagagattgcgccactgcattccagcctgggtgacagagtgagactctgtctccaaaataaataaataaataataaataaataaataaataaataaataaataaataaaatatgactgtctcatggtaggttttttcaacaaatatttcttgagttaatgaatgaatacagcgatgtagctgtcagacacagagagagaaacctagaagatagtattactagttaaaactagtgtggctaggtctgtatgatgaaaactgtgcctaactgtactgaatcctgccaaggagggaaagatgaaatggggaagctattactaagtgagtgaataggaatttccttcaggaaataaatatggttaaaaatgtgaattataagtgcttccagctgtctgctaatgttagtccttcagagaaatgaaaactgagaaaccattagaaagcaattttatcacttcttttaaaaaataaagttcaatatatttcaaaccagaatatcatcgaaatactgaagtcattttcaggggaaaatgccctgaaacaacaatttcatattatcttatattttaacttatgcttttatacatttgaaattttatttcatttgaagacttttttctaattgaaatttttgactgagagaacactcacaacttctgatgtaaaattttattactgaggaaaaactgttaaacagaagacaaattagccaattaatgtttgtatatacatcccacagtggacatattatttaaaatcttggaaagagttgtagatttgtgaaggtatatgtgagcttatttctaggtatgaaataagggagcaaagacacttgtaaattatagacatccttatttagtaattggatgttgaagatgaagaaatggctgaattgaatgaccacagagacgggacagaggaagtgatgtttgtttgtttgtttaattgtttattgagacagagtttcactcttgttgcccaggctggagtgcggtggcacagtctcggctcactgcaacctccgcttcctggggtcaagtgattctcctaccttagcctcccaagtagctgggattacaggcgcccaccgccacacctggtgaatgtttgtatttttagtagagacagggtttcacatgttggtcaggctggtctcgaactcctgtcctaaagtgatccacctacctcggcctcccaaagtgctgggattacaggcgtgagccaccgcgcccggctgctattttaaataatagaactttggcacttttcacagtattcgggaagcaacgagctttgctataggtacaaaaatatatttaaaacttcagtaaattattttaagtttactttcatcaaaagtgattaacagtaagttcaatttgtcagatattactctcccctactctagttctcttcaggttctgcaatatctactttgacatttatacacataagtttaccatttagatggtaaaggcaggctctgcaatgaaaatctttgacagcaagggagtagttgtcactttacattaaatggaagaaaaactaaacagtagaagtctatcccttatgataaagaatggagcatagttaagggttgcttcatacctttatcttaaactgattagttggcaaataggtcccttgtttgtttcctagataaattttctgtattctctggcttctccttttatcctgttaaagacacatactccacaacacttgaataaacaaagcatttttatgttcaaattatttctgtatgtgtctcctttaaaaaccaattatcttcttaagggagagactcacattttaaagtctttattttcatatctcacatttgaggctgatattatgtctgtattatcaataaacacttatttaaacaataagcttttcaaacagataaatgaattgaagccacatggcttatagatttctgcttttccttactttaggtatctggatttcatctgccggttgtaaaagttactgtgctatctaatttttctctattcacagtgcataatcagggtcttctttaacttattggagactgtgaatcagagatgcaaatatcctattttaaaatattaaggactcgagttgtataaattcgtgtacagatgcctttcagaaattaaaattccatttgtatgtatatttagaatttccttttgcagaaagagtggccaaaaataaacatcttacagaatttcagcggaatagtgaagtggtcaattcataggggcatgtcaaaattaagaagggatttgactaaaaagttggtactttatcattttgacatcatattttcagataagataaggaactattcagggagagaaatagaaatgctatattctatagtgattctagggatgtttatatcgccatagcaactacaagggactatggcttcctttttagagggtcagaaactataaagatcacttatttctagacaaactaaaatagtaaaatactatcagagatctcatctctgactttaaactatggaaagtgctacagcattttctttggtgcacataccatttttctgtgtgcagtgccttgaggacacgaatatgtgcagggactttaaaaaggatgtatttcctggactccagccaattttgacagcattctctgagaatgcaccaaggagctattatctagatatccagggagtgtgacatcccctgccccagtttttgctttttgcttttctcctttaagatagaaagttttcccgcgttagtaacatgctgtacagcattgctaaaaccgttcataacttgatgctgagcaatgctacagcattccaaagaattggtagctccccagagactcagattaaaatcaggaagctttgcaagctcaaatcctcagagagtatacatacacacacatacgcacaaacacacgcataccatatcaaagccataactggataacttttatatgctgatggggaagatcctttatctcttcccttgaatgtttttctccatgggtgcttacagctatgcatttaaagggtttgggcctgctatgtactaacaaatgtgattggttgcccaatgtgaatttaagtaatcagcctttcattcagctggagtcttggtatcaggtggaggacttggcagagttatgtatctttgccattggactggcagccaagcaagaatgatggagacagtgacttaaaagaattcagagttgaatcaagtacttgtgaaatcaggctgcccaggtcaggcaagttaacagaagcagccaagaagatatgttggtgcacgtttctggtacctgacctaatcaggctagcggagtagccctaaacattccacccaagactccaggcttggagccatcagaagatggtagtaaaattctaccaggtaaataaaagtaaagaaataatactagagatacgcttgagttcaatggcttttagggcattaataacaggtattacatccattgtatctcttttattataatttcaagtgtattttagattcaggaatacatgtgcaggtttgttacatggatatattgtttgatgctgagatttgggatatgaatgaccccatcacccaggcagtgagcatagtatccaacagtttctgttttattatgagttttgtttttatcaatatgaaacttttcttcaataagcaagcctctgatgtcaaatacagcatactgcaatgtcgtacaaagctattttctattttatagtgaaagatgatgacagcaaaagacagtctggtctgcctacatttatgttttccacttccaacatgctgttgttgctctcgataagatcaccaatgacctcctaaattgcccgagctgacttttccctcctggtcctggctgcatctgacttgttgacaactccctccctccttctggttctcttcctgggtctgatgactattattctttagggatactcatctccttcctctgcccatgctttccacataggttcatctttatgctacctttcttctcactcttttcaccctaaacacctttcctgagcaatctgaccatccctagtcttattcaacatcacacacattccaatgactatcaattctctatgtgaaattgctaaaagacagttttaacctgcattcctccagataagtaaattctcagattgtttctgtgttggcttgttctttcttttgtatggtaatacctgacctgtcagataagtactttttccacagagttaaattgaggtgcgaaacaaaagaaataatgaaagctttccatcacaaggtgtacatagactggaagagaatgccttgaaattttattttaaaaacaccttctttctctgaaattcactcacatcacccataaccattgtatcttatcctgttgctgagctgataaataagacacgagaacacagttgctttttataaggttcccattgtaagcattgacttttaccttttacaactgacattatctgtagtctcacctgcctcttcagcttagttcttgctcaaggcaagtcctcgtggaccacaaacgtgaaatcttagaataaggcagaaaatcctctaagttttattgttaacttctttcctgtttccctctctgattgtgaagttttcttcagagcccgtcatctggaaagctgtacgatcagcagcagtcactccctatctaacacagtctccaacttacaaatgattaaaatgcttcccaattttgactgaaaataggcaagaatattccctttgttttgggaggctgaggcgggtggatcacgaggtcaggagatcgagaccatcctggctaacacggtgaaaccccgtctctactaaagatacaaaaaattagccaggcgtggtggtgggcgcctatagtcccagctactcgggaggaggctgaggcaagagaatggtgtaagtaaacccgggaggcggagcttgcagtgagcctagatcagaccactgcactccagcctgggtgacagagctagactccatctcaaaaaaaaaaaaaaaagaatattccctttgttgatatttgttaaaatttatatttatctagtcaggaaacataagatctctggatgagagaatacatcattaattactcaaaagcatctcagggcaagatgtttatctgtgagtgcaggggttgtagtacaggagagaaatcccagaattgtggatcttggagattatatagagcacctgatgtatcaggaggagagaaagtgagagagacagacatacaggaagacagagactttgctctgggctataaaccaatgatctaggtctattatttttggaatataagttgaaatgtaatcaaagggctcttggagataaaagtttttaaatctctccagagcaatgcactaaactccaaggtacgcttgccattcagtcaccctttaagacagttactacaactctttgctcagaaagcctagtccatgtatccaaatgtgaaaatatgtatggctcagcaatccctgccatcttactcctcttctcaaaatctgatttcaactgcctctggaacatctacagtttgatgcctcaaaggcttttcagaatgaccatgtccaaaattgaactgatcacttatgcacacatacacaagcatgtaaccatggaacctcttcatctgtctgaaatcctgttacccaatgacaccacaaatcatgtggatgcccaggccagatacctaagactcattcaagttcttcctcttcttcacccaacacacagtcactgaattctgctgagctgttttcctaaacttccttcccacttcagctcaaatgtgaatagcaactagatacttgattcaattaatgaacttttgttaagactgtaggtgtgttaatggtattatatatgtactttccgaaaaaagttctcatgagagaatatttcagcaagagaaaaatgctgaagtatttatggagaaaataatatatcagtttgtttcagaataatctagttgaagaggtgagtgggtggattgtccatggagtcataacagttggcactggattatagggttatgggagctatttgtattattttcctactttcaaatatatttgaaatcttacataatgataactttttaaaaatcatagttccccattagctactgaagtacaggcagaattttctgttgagattcaaagcacattattgaacatcctcagcctctgtttcatgccccatcttcccctaagcttctatgttactgaaaaggcagccaaatatgactgcgcttgttacctagctttgcgtgtgtgttacctactagctctaatgttcttcccacttctactactcagatatgtctactgcaatttgcaccttcttcgtgaattctttcctgagcctatgaccaaatatatgatacatgttttctctaacttctagaaaatgtttggtaccacttggaacactcatttcttccttcttctcatccagctaaggcttctatacttggatttttttcttcaattcttcaaaccatatcctttcttactactacaataaaacctacttaaaacttcttaaaggcaaactaaactgtgtttcacccacctttgtttctgctatattgctccttacacatgggaagaactcaataaattttgctcagtggaccttatgtataatttagatgatcaaaataacaaaattcgtactaggaagaatagccagaatgtagtttttagcaaatttattgagaataaatatgtttagatttttctttcttcccgtataacccatttgtggtttgtgatttttccgttaaatagaatataaacaaaacattatggattaaatttatgggaccatctattcatttattcaacaaaaaagcttttgccatctatcatgtgccaagcacaggtttgagctttggaagcccaacagataacaacatccctgtagtcatagatttcaaattagtggtatataccggctacttgatatatattttaatgttagtaataagtactataaagaaaagggaagagtaatgccaggaataaagagtgattgctggtgctatttaaaatagagtagtagagaaggcccctttaacgtgagaaagaagtaagggaaccactgatagaaatgtgggttaggaaaactatttttggcaggtagaacagcaagggcagaaatcttgaagcaagaatgtagttgttatactcaagtaatgcaataaacctaatgagggtgaagtgttgtggactatgaagagactgggaagagatgagcttggaatggtaggtagtatacaaccaagtcatgtagagatttataggtcatagtgaagattatgcttttttaaaaaaagtaaaagcaagtttattaagaaagtaaaggaataaagaatggccactccgtaggcagtgcagtggcatgggctgcttgactcaggatacttgtagttatttcttgattatatgctaaacaaggggtggattattcatgagttttctgggaaaaggagtcagcaattcctagaactgagggtttctcccattttagaccatattgggtaacttcttgacattgccatgcatttgtaacctgtcatggcactgctaggagtgtcttttagcctgctaatgcattataattagtgtataatgagcagtgagaaggaccagaggtcacttttttcaccagcttggttttggtgggttttgactagcttatttacagcaacctgctttatcagcaaggtctttgtgacccgtatcttgttctggcctcttatctcatcctgtgactaagaatgcccaacctcctgggaatgcagcccagtaggtctcagccttattttacccagcccctattcaagatggagttgttctagttcgaacgcctctgacatatttcccctctttcttttacaagggaacccttaatcctaagggtagtagagttacccttaggattaagtagtagaagggtaatacatcttctgtaacttcttcaggctgaatatgggtgatgatatttctgcctaactattagggtctcttgtattcagggtagagaggagctcagtcagcaagcatcagcttggtgagggccattcataactgataaatggtgatatctggaagattagtaagttttcaatctaagaaaacattgagtaagcttattctgcattcctatacaaaaagtaaaacagcaaatatattccacaacagtaaaacacaataagtaaaattatcccaagtaaactaaattagaaggctttccgtgaactgggcagctgttggaaccaaagtgatgtggggctgctagctgattccaatacatgcccagaattagaatactgatccaggtttttatattacccatccttcttgtttcttctgaggtgcagtcagagatcactggcaggttcacaggaataagcaggatcagtctatattgcaggaaaaaactcaaaaacagctgacgagactaataacaggtgtaccatagttcttaaaacataatttttttctctctccagtctcccatttttactaaagatggatcatcataggactgatttgctttattatacttggcctgattatttgtataaagtgttgcaagaataattatttttcatgtaggcttttgaaattggctgtgattgaactctgtgatgaagagccaccagaagattttgagcagaggagtgatatgatcccaattatgttttaaaagaatcttttcggctcttgtgtggagaattatccagtaggggggaaagagcggaagcaagaggaccatttagataggtagttctataacccagatgagagacaataatagcttctatcagatctgtagcaagaaaggtagtgagaagcagtcaaattctgcatatgtcctgaaagtcaagccaaaacatttgcccaataatttgaatactggagactgaaaaaattaaggatggctccaaagttgtcaatctgagtaattgttaattgaattactataattcaattgaaatcagtaattgccatttactgaaatgagggaatctatgggatgagaaggattaggaaatgcagttcagaattttgtttgcgtcatattaagtttgaaagtctcgtgagacctccaagtgttgagaaattagcatttgttagactggagttcggaggagatgtccgggcttgagatacacatttgggtgtcattgtcttatataagatatttaaaattatgagaacaaatgggatggattatggacagagaagaaaagaagtgcaaatactgagtcagagcactctaatattaagatcaggatgagaaggatccagcaaaggaaagcagaagaggtcaggatacagaagccaaatgaaggcagttttaagatgtagggagcgatccactctctcaggatgaggtctgtgatttacctattgaatttgaacatgtcaaagtcactggacttcatggttattaactttaaaaagtcaataattaagaattgcaacaccatttgctacctttgggatttgtatatatatatatatttttctctttctatagacagctaattcatttttttactgttttaaaatttttatattacagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggtaggtaacacatatatttttcttgatacttgcagaaatgatttgttttcagggaactgtagaatttatttcagtaccctccatggaaaaaagacagggaaaaagaagtatcactctcattgaaaaatggtaagtaaaatgagaacaaataatgatgaacaattcagacaaatgagctgaactgtagaaattattcagtattaaatttagcgttatgttgaagcattatatcttctaaaatttcaggtaatcgtaaatcagattggggcattgaggtgctataaacagttgttcgatataacatatttatctttagtcaaatctgtatctacaaatttataggagtttgatacttagattaacatgtttaaaatactacctatcaataaaaaaattgattttcatttatttatattttggagggtgacactttacactttgcattaccctcccccacatttttttttgccatggggaatttgttaagttgatttaaaatcatgtttctttttatcttaattgaaatatttagctgttgacttaattggggggtggcagaaattcaattacattatttagcttcacatcacaagaagtggattactctttcttttacatttttagattaaaagtaataaagttctctaacagcttaaagtgattcatttcagaagtctttatcctcaaggtaggcttcttaattattctcagaggaaatcaaatcattcgtctaataattatagggaacctccatggtatctcttacatctgtccatttctaaccatctttactcctattttagttcttggtttactacatcaggcacctaaagagagatttctagcattaatctcagttgtctcaagtgattatctccactttgttctcaacgatctttcagtggccgtcatttttctaaagtgtaagagctttggtactataatctcattcccttgagaatgaaaccctgactccttaattgtgcaaaattatctggtcagcctcactgcttatttcttcgtgcctgccctatagcaagcccctccaattatgttctagcgatattaaatcaatttgcagatgcccaagtgttttgtactccctctgacctgcctgttcttcaggtctcacttcagatgttgtctttttctagaaatcctaaaactattagtcgctcctaacatctggaaacttggatattgtttcatcatttaatgtaatttaatatcaataaatcatttatgcatttgtaaattttccagacttggtggctaccgtgtagaatatatgatctgatgtgcctgctcctaaaacctaacacatagtaatcaatttgtttacttttctgcctcccacacaagctccttatagaaaagggctatgttttatttgtgttatatgctcaggactgatatagtgctgagcacaaagtgggtgttcaatgtgtctggactcaagcctcctctccgaaacctgagaatatttcccctttggatagtctaccagatttatctcactgcaccttccagggcaggtgcggtggctcatgtctgtaatcccagcactttgggagtccaaggcgggcacatcatttgaggtcaggagtccgagaccagcctggccaacatggtgaaaccttgtctccattaaaaatacaaaaatgacctgtgcgtggtggcatgcgcttgtagtcccagctactcgggaggctgaggcaggagaatcccttgaacccaggaggcagaggctgcagtgagcccaaatccaccactgcattccagcctgggtgacagagcaaggctccgtctcaaacaaaacaaaacaaaacaaaaaaacagatttatctcaacttccttgaaaatagctggtcccacagtatccaaagccaggcttgataaaggcaaagaaactcagccactctgtgtatatgctacaaatacaaacttaaacttataaaatggtggctcatgcctgtaatccctgtgctttgggaggctgaggcaggagggtcacttgagcccaggaattcaaggctgccacgagccatgattgtgccactgtactacagcctgagtaacagactctctctaaaataaattaacaaaaatatttgaataaacttatatcgccaccatggtgtactttctcccagcatttcacattgagacattatgaggctctgcgggctactccaatgatgtcagtttcattaccatcttttgggatgttcattccactcttgggaagttcttccccctctggtttgtcttcttatagtcagtgttttctccaagcattctaggccacccacaccatcccctaaggaccgttgaggtttcttggatagccagtgattactgtgcttctatatacacctaccagttttgcactaaagtagaaataacgctttctgctttttgaggtttctcctccgctttactcatgagtaatttttggcaaatgatccaggtattcccttctcactgggtcatatggacatttccctttcagtttaccttcaccttagacttaaacagaaacactaacgccattccacagagagggtcgctgaaatctcaccccaactctgaggacttttctggttttgacaaaggatagagtttctctagccccaatagatccaccctgtccttatccagaggttgaaattgtacttccattgacattctataggaattggtcaggagctgttaaatttcctatgacttttagtacaatctcagatacaaactgttttaagtaattgcttataagcacaggctctagagttccaacccgttttggaattctggcctttctgctatctatgtgcccttgagcaagtctcttaaatcttctgctccatacatttctgatgtataaaataggataagaatagtgtctatgtcacagggttgttatgaggattatctgacacaatatatgtggggagcttagtgggttgcttaaacacgataatggctcagttaaggttggcaattttgatgatgaaaatggtgatcttatggttctgatagtcatgatatctgttaattcattcttacatgctttcaaatttccctgagaactacagagagaagaattagactcagtccctgctttgaagagcttcacagtcttggagagaaaaggcacaaccagccagtaaaataagggttgatagactggagctgtacaagagggcaagaacaagatccctggggaatggaatgaagctatcttactaagaatggggaataagtcaaggtctatagaccattcaaggttctgagttacaactaacagaaagtgactctagttactttaggtagaattatataaattactagaaggatatcagatacctcatggaatcaataggaaagcctgagagctaggtttaacaatgggcagaaactataaaggaagagcaggctaggcatccagaatatatctactatcaagctatgaggtaaatctgaattattttgctgtcatgccagagtccattgctttaccaggagcaccattgcactggacattgcttgctatcgtcactgcaaaaaaaaagtatctaaattatttattcttgctgtgtgtcgctcattctacaactagggtctctggcagaagcatctgatagtcagaggatggatatttttttctgtaaaggggcagttagtcgatatttttgtccctgcaggtcatgtagtctctgtcacaactactcaactctgctgttttagggtgaaaaaaaccatgtataatatataaatggatggacatgttgtgtttaaataaaactttatttaccaaggcagatggcaggctggaattgctgatgggccatagattgatgactgctgttacaatacaggtttaggccacagaactaggttcttattgccagagatcagggaaaataaatagctgaatttgttcttcattgtagtggcagtcaacacctcgtgtcctactaagtcccatacaatggtagattcttgaatccttggagagatttagaagctatgcattcctgaatacacaaatgttcagtacagccttcatgtggtgttctcaacaaaaatctgctgagttttttagtaagccaatttgggttaaatcaaaataaatttgagctagtaagaagggctatattggtatttttcttaaatggtacatgtatggtagtattagctatgaccgcaataatgctgtgacacaaatcaccctagaacttgctgactgaaaacaacaggcatttctggctgtttaggttacttgtaccttgactgactcagctgggcttggccgggaagctctgcttcaagatgtgggttagtagagctaggttccatgatgcatgttggattaaggtctgctatatatgtctttgctctggacctaagatgaagggtcagtgacatgttttcatgaccagtcaccaaagtataaacctaaacctcccaagaacactcatggcctctgctcctgtgaagttcactgacatttgattggccaaagcaaattacgttgccaaatctgacatcaatagaatgagaaagtagactcttcctacagtggaaggggggagagatgttaatatttgctgaaccataattcaaattattagagatagttaataatttataacaggattgttttacagctagaaaatgccttagtggttttgccctgcttcattattttataagggagaaaactatatttcaaagatgttatgtgacttgcctaagcacatactaaatagtacatctgcgtatttctcgttcagtcatctctattaaatgtcataaggtaaaacagacattacgctttagatgagaacaggaagatatttaaaaagccagactaatttatgactgctcattcattatctaacatacctgcttccatacattgtctttcagcaaatagaatttcaacatgtatctcaacaagttacacatcatcaaagtattaaaagccttattttcacggacattctgattgttcactaacagtcaacacagtcaacagtaaatccacaagcaccatgaacgtatggatagatatgcctatatgtaagattactagttaactttttgggaaattaatattactgctaaattcagttttcattgattttcgggtgggtaactaactgcttataaaatatacctataggaaacatgtaaaaacaaagaatttacataagatctatctgggattagagaaacaaagctcttttcttctttcaatgaacacttaagaagggcctactaaatgtcagatgttatactctattgtcgttagtttctttctgataccatctttactatcctgtaagccattagtgagtgtttcccacttttagaaaatgacttcccaaagactaagagggtagaacagttcaaatgctatcatcaaaatgaaggcagtttctagactacaaattgctgtacagccataagatggcattattgtgtaacaacaaggtccctgtcaaacatcaagaaagtaatgttttaaaatcagtatttccttcttggaattctacttagtcagatatgttgggttgacttacccacccatataagtagttaaattcaagatggttctgagctttagatatgatgtaaaatagacatgagactaagagtatttatttctatattattacatttctatagcaaaaaaagaaacctctaaaaaaattagagaaagaagtataagggcatttaattaatcaaatgttcttattaataatatttcataaaataaaggaaatgttgaaaaataaaatatgaacacagtgttgtataaagtaagtcagaaataagagaacacttactgtatgaatctattatatgaaactaaaaaattaggcactttggagtttagaggtcagataggagttacctttgtgagttgtgattaacaagggctgaagcaggcttctagggactgggtaatgttttgtttcttgatgtggatgctgcttgcattgatgtgtttcctttagggaagtttatggaaccatacacttgtgatgtgtacacatttctgtgtgaatgctggactgaactaaaatttatacttacattttaaaaataataaatatgtactttaagtacaggagggacataaatcataattgttttaataaagaaggtgtagctttaggaaaagcataccgcattgttctatttttggcatttcaccatggacccctgaacattttataattgcccagtacagcctgtcagataaatatgtgggcactactgctttagagaaagtattttccaaatttatcaccaccattctggaaccacagttccacaggtcattaggatgctgagggtgggacagttggaagctgcttccccagggatttctccattgttcagttctcatagcagtaagcctgcagcattaaagcactcacaggctctggctgccatttgtgctacatgaagaaaaatgagaaaatgaaagaaacgaaaggagagaaaacaggagtagaaaccaaataaatcagattcgaagagaaagtccctaatcgtctctgtattcagacagtagggaatgagcatgcaattctgcaagcccattcctaatgtgagtttctgataagaatttgctatctcagttgtaatctttctactgagacattcaataaataattttctttcatgtcaaggtaaggaaataacctcacattacccatataaggaaagaatagtatactaatcctcacgttatcactatagaattttatcttttaaagtggaagctagagggacagatgcataatctgggagcttttccagaattgtttgttcctaaatgagacattcagctatagcagcattagcagcctcttctatttgtcacaatgccatatgtagttgggaagatacatgataagcacatacaggatgctgacaactcacgaaggattatcattgcagtcttagaattaatctctaccatatttgaagatttttatgcaagactggatcttcattccacaacccaggtataggtatatgtgccaatacaaaatacttactgttggtttctgagcttggtagaattaggaagtaaggggtaaaaaacaagcaagtcctgaacttaagaaagttgttcatatcctattccatggccactgttttactgactggaagaaaggaatcccgtggattcagtcatggggacaatgcagaagaagatacagtagacagacagagaagtacaaatttctatttatgttccacttttcaaaattttttatctttaaatgttatttttaacgtttgtgggtacatagtgtgtatatatatatatatatatatactgtatatatatatatatatactgtatatataaacacacatatataaatatatactatatataaacatatactatatataaatagatttactatgtatatacacacatacatagtgtatatatgtggggtatatatatatgtggggtacatatatatatgtggggtacatatatatatatgtggggtacatatatatatgggttacacatatatatgtgtatatatgtggggtacatatatatatatggggtacatgagatgttttgatataggcatgcaagtatcatggaaaatgggatgttcatcccctcaagcaattattctttgttttacaaacagtaaaattgtatttttttaattgtttaaaaatgtacaattaaattgttttgactatagtcaccctgttgtgctagcaaatagtaggtggtgttcattctttctaactattttttgtaccaagtaaccatttcaacctccccctcaacccccccactacccttcacagcctctggtaaccatccttccaccctctatctccaagtgttcagttgttttgatttttacctgccacaaataaatgagaacgtgtgatgtttgtctttctgtgcctggcttatttcatttaacacaatgacctccagttccatccatgatgttgcaaatgaaaggatctcattctttttatggctgaatagtactctattacgtatatgtatcacattttctttgtccattcatctcttgatggacgctcaggttgcttccaaatcttggctattatgaacagtgcttcaacaaacgtgggagtacagatatctctttgatatactgatttgctttctttgggatatatacccagcagtgggattgctggatcatatggtagccctgtttttagtttctgaggaacctccaaactattctccattttggttgtactaatttacattcctgccaacagtgtacaggagtccccttttcttcacactctctccagcatttgtaattgcctgtcttttggatatgtcgttttaattggggtgagagaatatcccattgtagttttgctttgtatttctgtgatgattagtgatgctgagcatattttgatacacctgtttgccatttgtatgtcttcttttgagaaatgcctattcgaatcttttgtctattttctgatctaattattagactttttcctatagagttgttttaactccttatatattctggttattaatcccttgtgagatgggtaatttgcaaatattttctccctttctgttggttgtctcttcactttattgattgtttcactgcggaggagctttttaacttgatgtgatccatttgtctatttttgcttttgttgcctgtgcttataggatattactcaagatttgttttacccagacagatatcctggagagtttctccaatgtttccttgtagtagtttcttagtttgaggtcttagattttagtcgttaatccattttgatttgcagttctctgatggccagtgatggtgagcattttttcatgtgttttttggctgcataaatgtcttcttttgagaagtgtctgttcatgtccttcacccactttttgatggggttgtttgtttttttcttgtacgtttgtttgagttcattgtagattctggatattagccctttgtcagatgagtaggttgcgaaaattttctcccattttgtaggttgcctgttcactctgcatcaattttgcatcaatattttttgcatcaattttgcatcaatatttatcacatggtagagttcagcagtgcagccatcgggtcccaagcttttctttactgggagagtttactaaggcttcagttgtgttactcgttactggtccgttcaggttttggatttctttatggtttaatcttggtaggttgtatgtgtctaggaatttatccattacctctagatttttcaatttgttggcatatagttgctcatagtagccactaatgagcctttgaatttatctggtattaattgtaatatctcctttctcatttctgattttacttatttgggtcttctcccttttttcttcattagtctggctcaagatttgtcaattttgtttaccttttcaataaaccaacttttcgttttgttgactttttgtatgttttctttattacaaagtcatttatttctgctctgatctttattatttctttcttccactaattttgggttcgatttgctcctgcttgtctaggtctttaagttgcattgttaggtgatttatttgaagtttttttcttttttgatagaagcacctacagctgtaaatttctctcttagtactagttttgctgtatcccataggttttggtatgtggtttttctttcattttttgaagacatttttcaatttccttcttaatttcttcatagacccagtggtcatttagtagcatattgtttaacttccatgtgtttgtatagcttccaaaattcctcattgttgatttctagtctcattccattgtggtcagagaagatgcttgatattatttcattgttactgaatttttaagactgcttttgtgacctactgtgtggtctatctttgataataatctgtgtgctgagaagaagaatgtgtattctacactcattgaattaaatgtcctgtaaatattagatccatttattctatagtgcagattaagtccaatgttactactttggttgagcttctgtctgggagatctgcccaatgttgaaagtggggttgttgaaggctcctgctgttattgtattgaggtctttctctctcctgagctcgaataatatttgctttatatatctgtactccagtgttgtatatatatttgctttatatatatatactccagtgttgagtgcatatataattgttatatcctgttgctgaattgacccttttgtcattatataatgaccttctttgtctcttcttacagtttttgtcctgatatcgatttggtctgatataagtagagctagtccagctatgtttgggtttccattggcatggaatatctttttccatccctttatttccagtctgtgtgtagctttataggtgaagagtgcttcttgaggtcaacacaaaattgggtcttattttttcatccattcagacactgtatctatttttcttttcttttcttctctctcttttttttctatctttctttcttttcttttctttcttgagacagcatctcactctgttgcccaggctggagtgctgtgacaggatctcagttcgctgcaacctccgcctcctgggttcaagagattcttgtgccttagccccccaagaggctgagattacagtcacccacaatcacgcgtggctaatttttgtatttttagtagagttggggtttcatgatgttggccaggctggtctcgaactcctgacctcaagtgatccacctacttcggcctcccaaagtgctaggattacaggcgtgagccaccatgcctggtcgagacactgtatctctcttgattggagagtgttgtccaggagctgagcctagaaatgggtcctcacaacactgtccagtgccctatcctactgtgactaagctggtatccaagatgcaagacagaatcctctttacttttcactctcctctccttaagcaaaagtaaggagtcacttttgttactgtgggctgcactgcttgaggtgggggaggaatggtgcaagcactcccttagccatgccagctggtgtctccctaggtcacatgccaccctagtcctctagctcttagcccaggctatgactagaagttatctaggaattgcagttcgtgtgtcccagactgcctctcaggtttacctgggactccagagcactttggcccacaatggtgaggcttgccaagaaacttgagttctgactgctgggatgggcgattcccttctggctggggctagttcaaatattccctccgtgcacaggcactgactgaggccagcatggcttttttctctactgtgacagcacagcagttagttcaatgtaaagtcccccagtagctgtactgtcccttccaaaagtgcaaagattccctctctgcactgcacgtccagtgctgggtgattgggaaggtgtggtgttggtgattcaagactgtgtctcctgcctttcctcaatgcctcttttagcaagatgaagttaaaaccaggtaccatgattccgtacctggtttttggttctggtgacagtgcttttctgtctgctcatagttgttacaatttgatgtttcagtgagggagattagttatataggcttctattctgacatcttgcaccactccgtctcacttttttgaattgttgaaaccatggtttatggggaaatgttctgttctggtttttaccctcaagatcttctttgaaaatcatgatttactaagtaactagttggatagaattcatttttaagaaaataatgaataagtagttcccttagatatagcaagcaatgttcttataaactgacacaccaaaacacttaccagttcacctaaacactgaaagtatttaaaaatttatttttaacctttaagtttttctccatttgagtatcttgtgcactatacgctctcctacatatgtctacaatctttggtctgatttattttattggttgttgaatgtcagaaaccacctgaattttgcttgtatatataatgcccagtagagtgcacattggtaatcaatacgacttgatgataataatggtaatgaacactataatttgatagcatcaacttggcatgtatgccagaaataaaccatcataaacttcgagaaaaacaagtctcattaatctgtcatttattataatctccctccatcaagcgtagcctctatatactgtcttttttgccatatgtaagtttcttcttgtatatttcagattagagcttgcctcctcccacacactatcttctatttcacactgctctgttcaagtgtttatgtttctgctgaaggctgtataatctaagataatccctagctattgtaaatatcattcactggccagtcattgcattttgcacaccactgagagagtgattgtgagccaaatagaggagattttgtttccacccagcaacccaaaatgaattgtgtgatttgactattgatgccaattacatggaagttttactaccagaggcaaagctttaaactgcaaaagattaaccccatatagttggtgtcatgaggtatttaatgtatattggactatcaaagcgtctccttacaacaaaccaattatcaatgaataatattcttatcttattgtgacttattgaaactctttaaaaaacatgaaccattcagcacactataccgtctaaattagatatctaaactagccttcatttacatttccttgtttagttttaaatataatttcttctgaattcttagttgttaagagcaggtggtgaaagaatttaaagaagaaaatttgttgtatttattaagtgaaagagctttttgaaatgcattaaatagaagtttgtttctgcccatcagcttatcttctgcatattcctatttatagttcaaagcacttaagagttgcagagtgatttgctttttatgatcaccgcttcatccaggatcatttgccttatatcttcaacattttcagattcttataaatcttcacagttcacttagaggttagtttaaaactttcttcagataagaaattgactagatataaaattcacataatctcagagttagccatagatcaatatccccagtctttttctcaaagtaattgaacatttttgtttcccaggatagttgtatacaagcattttcatcctcaccatagatgattcttgttcttcagtatatgaggggactgtatttgcctgcttgttatctaaataaacatttttattattgtcaaaggaaaaagactctaatacagaaagaaattttgtgtccataggactagcctcattttggaggctgatattaatatttgactttattcattgtgtatttcttggttttgtcatttcacaaatttcccttctctaaatatgcattttttctctacctggaatagatgagttttaaaagacattactgtaaaataaaactgtgctaaatgtacttttcccagaaactctctttattttatcaattataatttgctttggctaagtgttacagaagctcaaggtagaaatgacttaaataaaagagaagcctatttctttctcctgaaaaaccctggaagtttgcagccaaggcagatatgttggccccgctcatttctgttttctactgagtgagttatctttacttggtggaatttcatccacatgttgcaagatggagctctcatgacatccacattccaagaaggatgtaagaaggccagaagaagggtcaaagggtgcataccaattgtcttttagggaagtttcgtgggagctgccatgttatatttccacttacgcttcattggccagatgtctgtcacatggccacatctaagctgcaagtggggctgggaaatgtgtttatttcacatgtgctctgctaaaaactgttcagtcatgaaaaaaaaaaaaagaatattggaagagaactaacagtcttcaacatgtatatttaaaaagagcgttatttttcttttacttatttatttttttttgagtgagagtgttgctggggctggtctcaaactccctggatgaagtaatcctcccacctcagccttctgagaagatgggattacagaggcacaccactgcacccggctcctgttttgttttgttttgttttgttttatttaaggagccctaagaagagtgtaaaaagggcaactttgtctttagttaacccttccctttttttttctttcctaattttatgaactctgattcagcccgcatcttactctggcttactaaattctgccaatataagagtagaagttttcatcatttccctaggtacctactcttctgtttctccatattctcaaagtaatttctcattcatcaacttttgtctgacttagatttaagctactgcttaggaaatgtgagaaatggagaatttggttgtcatagcgctcctacttagagggctaatgctttcctaaattttactaaagttggatcctaagttatataagttacctaaatttaattagcaagttttgcttactaattcactgactaaccactataaaacaaggacctaagtttaaagctgatattatgacaatgtactgaaatttcaagacattactttttctggacacgtaggatggaccttgcataagataaaagagcttatttttaggcacacctatgtgccaggcatgggttcagagccttacatatatcatttcattctcaagagaaccttaattttagagacgaataattttgagttttagaataaataattgtcttaagctcacacatgaagtatgtgccagagtctatatcgtgaccccagttatgaattcttttccactacatagcctgcctccatggcatttcacataggatttcttatgctcaaggattatgttcttccttccagatctatagacatcagtagaaacaacacaaatacgtataatgactttttaaagtctcatatacaagaccaaagtactttaaaaagatgtttaaatttttgaaggtgatatctttatgttcgagatcagtagcagaaatggattgtaattcattacaagatgcttagcaaagccaagtggtaaaggattttctgatgtgcttgaggagtcctgacttgctccttagcaaattcctacacaccattcagcattcagtgcaaataccacctcttggaatccttctctgttcttgatcaattattccattgtctggattcatagaactctctgtttacctatttatcttacaggttattatcatgagtttatatgtcttacatagctgtttgcaacatgttaccattcagtggagtactttttcctacagggaagaggctgtactatataccttttgtcacccctaagtggaatgcagtatggtttcatgttagatgttcaatacatgttaatattttattgatgagcccttaaatgtatataataagcttctcactcaaaagctgtaatattctagaatgaataagtttcttgagaaactctttggttaacagaatctccatttccatcatagtgtattcaataaattattaatgcagggtaaatttccttatatttcctttcatttcgctatactaaggtcaaatcatgacttttaggtgtggatacagcaatatataaaataatctaagacctggatatatgtttttctaattagggaattggagatacatgaacagtctctcatagagaaaaatatatccattagtcactaaagtcagtataacattctggtgaaaggtttgcttgcttgcttgtctgcttacttgcttgtttcaccttctattctaggaggatgtttgtcacaattatgaaattctaacgctttaaaaatctgtttaccctatgaaagttgcaaattcttgcctgtaaggcaattttcacaagaattattttcatattagttttagtttatccgtggatagtctcaaattcctcttgaaaatatcagtgttctcaagggaaaactgcccattacaagccacagatgtggttttttgagagatttctgcctgaaatacaagttttaaaatattctttgtagtttcctagtatggctagatacttgtaggaaatgacaatttagatgcacatttgaaaattcttagcctttgagtaatttatatgtttgaataaatttaaactatctttgttcataaaaaggcaaattttgtctgtttgtcttgaaatgcttttttagtttcttcttcagttctttcacttgtctttctgtaatattcaaaattatagcatagtacttgaaaaccaaggatggtccagtctgtgtcctttgttttgaaggaattttggaatcatcagagatataattctggaatttctttgggtaccttccataaaatagtagcatcctgataaggacgtagatgctaacttttatttttatctcattttctttcccctatctctcagtaatgtaggagtgacccaaggtagctgtttattgggccctcaccaaagtcaatcaatattagtcagctacaaccacaataatgctgtgtgacaagcataccccaaaagaacaataagcacttatcctcatattcacaggcctactttgagtaatctctgattcagaatctgactgtaggttgaccaaacatgtctgatctatgtgtctcattctggggctcaagctggaatggcagtagatatttggggcacattcctccatggctgagttctaaagatctcagaagggtaagcagaaacacatgatggttcttaagacccagatttataactagcgttctctcttccatccatagtcaattgtcaaagcaagtcacgtggcatatccaaagatcagggatagagaaatacacttggcagttagtgaacccatttcaagagtgtgggtgtataacactactacaaaacagaactgagacttgcaacttgaaataccacaccattctagtagaattttattacagtattaattaaacatttttgataaaacacagacaactctgttagaaagcccaacttacaatttgttgatcccacttggaaaggtattctgaatccattttttcacaagttttctttctaattcaatgtgttggggtacttttattttacccagaaaagtaatattataaagcataaagttaatgccccctgtaaaaatagaatactgaaacaaactttaagtcacaattttattatttactgacttgagaatctccttgtgcttcagcacacttggtagttggatttccaaatagcatcatgactttccatacccagctgtctgctgctcaaaactaccataagctgactatcacagctcacaggatacccttgaagaagaccatctggtttatgtctcttggcaaaatttgtttaaaaacaagcagctgcatgacaaagtaagaaagagtctctgtctagctgtggtaaataagtagctttgcaatactcataataaagcatttttctaatccaagccaacatcttcaaaaggaaagcattattttcttacaactgaaagaaaaatctacagaattcagtgatgagggaaggactccattaaatttgtttcagcagcttgagatagtgagaaaaacaaaacaaaataaaaacctgtttgtgattagatacagtcttgtaataactagttttaaaagtatttatttagaatctaatacttggatattattttaattctttatattaagagatttacatttcataaaagcttgtcctttgaaccctaatactcatattgtgatggtgagccggaatgagtaaggtcacttactatatagtcggtatataataattcgttgaataactctctctcctcctgttactggcagtgaatccatacgggtcttcagcaaccttaattcatgcctcctcagaagaaagaattcgaccaaggaggcataaggcagaagaagagactgaggcaagtgttagagcaggaatgaaagtttatttaaaaactttagagcagaaatgaaaggaaataaagtacatctggaagggggccaagtgggcgacttgagatattaagtgtcctgtttgaactttgatttatggttttgtattttggcatacttccatggtcttatataccttctccccaattcttcccttggggtagggggctatctgcatgcacagtggtctgctgacacttgggaggggagcatgcacggtgtatttactggagttgtattcaagaggtgttcccttaccagtcaagtgtttccagaggaaggtcgtataccagttacactatgacattttgcctcttagtgcgcacgcgggagcccatttgcccaactcctgcgatcttatcgggaagctgctgatcaccaatttcaggtgtttttatctattgggagactgcctttccctggtattggctgtgaccaattattattttaaagacacagtttaataaccacctgactgaccatcacttgatggttgcctgacattcctggttggggtggcgggggtggggggtctcctaccctgctcatatctgactagctatctactgtaacactactattaggtatgtctgtatcccattacactcactctctattacaaaaaagagtaccttattcatttttcaaaagaatgagtgaattttctgctccagttaagtgcttttccttacctctatgtagagtgtcaaactagccatgcttaaggattgattctggtattaataatataaattcttgcattatgagtgtctcagtttgggttcttacataagcaaatcctgagacaaggatgtgagttcaaatagtttctttgggcagtgattctaggaagctgtggtaggatgttggagttgtgagaaagttaagagaaagcaacctgtaaagagtatgttatcaagccaaacaccactgtgagaactagggcttaattccctggagaaagtctgggaaggcataaaacacttgtctcagagttatcttagacaaggtgcaggagctgaggtgtttatatttcaactcttgttagtcacttttaaagggccgctcagggtgtcagggtattaatttcctcttgcaactacttccaacctgtttttgcatgtggttgtagctactttttctgcgtcaaagatagactttaggctaagacatgcagtttccggctgtaggacatcaaccagagtaccctggagtgtccaggcccaagataatgggtgagctccacctggatctgtggcaatgtgagggaggggcattattaccctagcaagggccactgcacttccctatccagctggtcactcttctgcgtatttgtgttacttttctgactcctgcattcctctggatcctgattcaccatcagcttttgtattctgaggcttgtgtggctgtgtctttctatttcttccttattgacttacttgtttaatcttttgctaatgtatacctttgatattcctatgtactcacctttggttagctctgtgaattattgagtcttgctttacagctttaaaaagatcatagccatggtttgttttttaagtgtgattcataacagttagtgacaaaattagaagtggaaattaaaggtcacgtgcacaatcctacacaagccaatttcttgaacgacataaaatacttgaatttgtcttttactatcaccaatatagaaataatttgggggtatttctcaaagtattgatttaacaaaactttatttttgtgtgaagattttttcaagtctcctggaaattattcaaattattgtctttaaagtcaaaggaaaggttaatattagggttacttttctttggtcacagaattgctggaggcttctatgacttgctttgaagcagctgactttatgcacagttttggttagaaattcactaccaattccaacattttcaaagtcctaaaagaccaaaagtacaattcttgaaatatccctagagaaagcaagaataaattagttttcactagaaatgaagacaaatttttctcattagttcattttgcctcatgatcagaattctttgccacatgaaaatattttggttaataggttgtaacataaagagtaatatgaatagagatctagcccaattagatgacagaaaaagagcaaagcttttgaaatgtataaagaagaaagtttaagagagacatgaacaaggctggatgtagtttaaggttgaagaacacagaaaaatgagataagtgaagttaagtgaaaatccttcccttactgagaagaaagagaactcaaaattatgtgaaggtttttgttttactttgttttgcttcttaataaggaaacaacagtggcaaatctggggcattaggaatggtggaacttctataacagtgatgtttcaaaggtcacaaaggaaattaaattgtagattgggtttaaaagcactggaattacttccagccccattttttcaggattttgtatgtagcaggaaatagatcaccgcatagctaaaggggagaatttaggttttaactggtctcagtgcaaactgcttcatagttcctttgcatttggtggtgtatgtaaaacatgaaaggtataaacatttattatcataactttattattatacaactatttattggctgcataggaccatgtgtcttcttgcaggtataatcaaaaataaaaagacagaaatgtatcttatatgaaggctgccattatcgctcttatcaatggccataaaatcagatttcttacatgtacaacatatgaaaatatattaaatatgaaacgttttccattaaataattctgtaaatgattttcataacatttctgtccatgatgtgtaaatctgtagatcaaatactgcaagtgtacagaacttaaaatgctttggtcaaaaaaattctcttattaatatgacaatggcgttcaaaagtaaaaaggtaaaaatacagtttagcattaataagtaaactcagaaagtaaaatatattgatcatacagtctgtattagtctgttctcatgctgctctaaagaactgcccaagactgaataatttataaaggacagaggtttaattgactcacagttccacatggctggggaggcctcagggaaaacttacaaccatgccagaaggggaagcaatcacatccttcttcatatggtggcagaaaggagaagtgctgagcaaagggggaaaagccccttataaaaccattggatctcatgagaactcactatcacaagaacagcaccatggggataaccgcccctgtaattcaattacctccaactgggtccctcacatgacacatggggattacaggaactacaattcagaatgagatttgggtggggacatagccaaaccatatcatttcatccctggcccctcccaaatggcacgtcttcacatttcaaaacacaataatgccttcccaacagtcactcaaagtcttaactcactctagcattaacccaggagtccaagtccaaagtctcatctgagacaaggcaagtcacttctgcctaggagccataaaatcaaaagcaagttagttactttctaggtacaatggaggtaccagcattggttaaatacacccattccagatgggagaaattggcccaaacaaaggggctccaggctccatgcatgtcaaatccaatgaggcagtaattaaatcttaaagctccaagataatctcctttgactctgtgtctcacatccaggtcacgctgatgcaaggtgggctcccacagccttgggtagctccactcctttggcgttgcagggtacagcccccttcctggctgctttcacaggctagcattgagtgtctgtggctgttccatgcacacggtggatcaagccctcttctcacagctctactaggcagtgccccagtggggactctatgtgggggctccaaccccacatttctcttctgcactgacctagtagaggttctctctgagggccccatctctgcagcaaacttctgcctggatatctagacatttccatatatcctctgaaatctaggtagaagttcccaaagctcagttcttgacttctgtgtacccacaggctcaacaccacatggaagctgccaaatcttggggcttgcaccctctgtagccatgggctgagctctatcttggctccttttagccatggctggagtggctgggatgcagggcacctagtccctaggctgcacatagcaggggggctctgggcccggcccaggaaaccattttgccttcctaggcctctggtcctatgatgggaggggctgccatgaaaacttctggcatttcctggagacaattttcccattgccttggtgattaacatttggctcctcgttacatatgcaaatttctgtagtcagattgaatttctcctcagaaaatgagtttttcttttctattgcatcttcaggctgcaaattttctgaacttttatgctctgcttcccttttaaacataatttccaattccaaaccatatctttgtggatacataaaactgaatgcttttaacagcacccaagtcaaatcttgaacactttgctgtttagaaattccttccaccagatgccctaaatcatctctctcatgttcaaaattccacagatctctcggacaggggcaaaaagccaccagtctctttgctaaagcgtagcaaaagtgacctttactacagttaccaagaagtttctcatctccctctgagaccacctcagtctggactttattgtccatatcactatcagcatttgggtcaaagccattcaacaagtctctaggaagttccaaactttcccacatcttcctgtcttctgacccctccaattctctaggaagttccagagtttcccatactttcctgtcttcttctgagtcctcccaactgtttcaacctctgcctgttacccagttccaaagttgcttccacatttttgggtttctttatagcagtatcccactctctgtggtaccaatttactgtattagtctgttctcatgctgctataaagaactacctgagactgggtaatttataaaggaacgaggtttaattgactcactggtttgcatggctggggaggcctcaggaaacttacaatcactgtggaagcagaagcaaacacatcctttgtcacatgatggcaagaaggagaagtgccgagcaaaggaggaaaagccccttatgaaaccatcagctctcatgagagctcactatcataagaacagcagcacgggagtgaccaccccccatgattcagttacctcccactggatccctcccatgacatctggggattatgggaactgcaattcaagacgggatttgggtggggacacagccaaaccctatcactgcctttaagatctatgaattgtttttctacattgaagaaatttgtagacatttgttttttattctctttttggtttgctgagagcagtagtctcttggaagtgagtttcatttacattttttcctttgggtgtcaaatatataaaatattttttaaaatcaatggctgagggataaatgagggttggtagaaagggaaaggataagggttgtagttaacggaccatgttttaatgtgtctataattagatggaagttgtctcttaccattcaacatcctggatggccttcctatagaggacattttcatcttcttttgtcgtccagagctagcatatgtgtttcatgtctttagatagtgaaaatcaattcagattttcatggaaaatgctctctcttcatcctaaagacagaattgtcacggctatttcgtttattgaaaagtgaaacctgctacagttagcatatagttaattccatatatgttacctgtatcatttaatacattcacaaagtaaaaaaccaaattttgccaagttcttgatagtaacaatagtaaaatggaatttctgttggcatattttcatgttattctgaaatgctgaatggatttattaagattgataacaatatgttgtacctttatgttctaaaatttaataacagttattcttccaaacatgccagcgtcctcaatagttgacagtctgcaaaatattctattatgcaatcagccatatctccttcttgagctttctttaagtacttgtatcctgtatttttccctgaaatctagcagtaagttgaagaaatgataaacaaaattgtatcattgtatataatggctatttataaatactgatgtacattttcataatgttatttaaatgattacttcagatatgtatttctgttttctacattttaacttctcaacatattaggttgttatcttagattggattttctaagacatagactctaagacagagatttccatgcagatggtttcttagtgagtgcttttaagaaaaatgcctgggagggagtaaaggcagcaggattgaggagagagaggagttgaatgatgatgcagtgaaatggaagatcttatctggtcccatgtggggttgggatgaccatttagagtattaccgtatgaagcaaggaaggtggaccattgtatccctaatccattagtcattagatgtgagcctcccaactaccagcttccgggcaatatcatcttggtcaaagaagtgcctgtctgctgagagaaatttcttggaagagcttaggtatgatctgttagtagataacaatcccagcaactgggagaatgaatgcttcatttgtaattggtgaatctcggtggcacaccacagtgttcgctacggtaatctttatacttattgagacatatattgtttttaagtaaaacttgtatacctagtaatgcatttaggtagtgtattggccaagctagtcctttttggaaacaatttcattgtggtataaatgatatacaataagctacacatttaaatagtacaatttgataagttttgacatatgcaaataccagtgaaactattagcacagtcaagataataaacatatccaatatcctcacaagtctgttttcggtaatcactctctcctgcccctcccttgattcccaggttaccactgatgctgactggcattatagataagtttgcgttttatagaattttataaaagtagaatcatgaagtatgtaccttatttctggtctgccttctttcactcacaaactactaactttcattttgtgaataatatgatctccgtgtgattacacacattaagaaagtcaataaaaacattgtaatttgattccgatactagtttatgggtctacattatgtatttaaagatactatcatgtttggattagcccttaggtatcaagtaaccctggagttgaggcagttactgttttatttgctatcaatctttttataagctcaccttccactaattacccaaaaatatttgatttaatacctgagtacagaaaaagaacatattcacaatgtttaaattttataatttaatattataatttacaacagtttaaaataactagtcctgaaattgagtatttctcacctaatattctgctctatttattacccactccacgaaaaaatttcccagaaaaatcacaaacatgtctcttgagtgtattattacccaacccacagaagaatttccaaaaacagtcgcaaacattctctcttgagtgcaaccattttctcgggccagccattcattgaaacaaaatagcctgtataacttctgtgggtagacatttgtaggttgttcttttgaggcattagtgctattgcatttaagataaagaaataacgaattcacaaattttataaagttctcttaaatttaccaagtcaatagcaccaccactttgattcctataacctgtgacttagttaggcttctcaattccaagaacataccaccattatttcttataatgtcctcagattaaaacatgtgttgtcctttctttatacctccctgcactttaattgaatattttgccatttactggattctgtacactttttatgttttcatgccctcccttttcattctcctggacatcaatcgcaagtcagtagataccttgtaagagatctctctccacccaaatcactgtttcttttgaaagagttaacctttctgaagcagcactcctgcttcacatttcccagcacaggaaccttcagtgtttctctgttgatagctttgatttcaaacgggtagccccaggagaaaagagagctgaaggatatgttttgcttggctgctttgtttgacctgcaaggaacattaaaaggcaatgaaaccgggcagagactggactgatcaacaccatcagtttagcacttattgctatactttctaaggctttacaattttatgtgtcccacgtgtcccctgaaggcatttgattttctaacctcctaggccagaggctaacatccagaattcatagtctggcacttataaaccctaacttagcttctgtcacttgtatctctatgcaactctacagcaaaatgtacttattttctctaaaatacccttattccatacttctttggagtgtaattttatatataaaagtcctcaccacctgtaaacattaggaagctttgattcgaagaagcagaagccatctccatttaactgaagtgaaatgaaacttactggagggataatgtatagttcttggaaatgaaggaaaagaaggcaactgtggcagagggagggcagcactgagagtcaggaactccagggaagttactttttggatgctgtcattaaaatgcttcagcttcaaattgtactgactctacctttctcaattctagattcaaatttctaaatgtaattggcataaattaggaacttgtcccaccagtttatagagtttacagagcactatgattataggtccccctaagatcatgcagaatgagggaagagtaatttcatccaaggaaaagcagggtaccattcaccaaagagtggagatacttattcagaacaattaatgttagatgccacaaaaaaactaaccctgaaatcaaagtggcctaatgaatgcttatttattgctcatataaagtctgatataaatcaggtagcattccttcacagtgactcagggacctaaattgctttcatcttgtggctctgccatgtcaacattgaaacttcagaggtattgacaaaggagagctgagaaattgacactaactatcaagtacctcaggcaagaagtgatgcatcacttcctacactttcccactttccaggattcaatcacaattgcactcacgaaacctcaagggaacatgagaaacataatgaaatcaataccaagatatccaaagagtactaattttcttcaccacagaagggatattggacagacaaaaaattttgggacagaggaatatccactaaatgatccttccatgccctgctcagatgctacattttccattaaggctctcttgaccaacccataaggagatgatctccaactcctctgaacatctggaacattgcattctacttatttttactgtctcctattgtaataattgttggctattccttattagacaaattataagcttttatgggacggtgatcaaaagtcctaatttatcttgtcttcctacagcattcaaagcattgtagaccttcaatacatagcagtcttcgaagccagagtattagtattttttctaaaactgtattcatcgcaacgaactcgatggatgttcaataaaaatgtattgaatagtcattcatgcagatagcaaatttcttaaaacatttcttactcaatgtttacttatattcatcatgaatataaatttaatataataatatcaaatcccattacatttagtacaaagtaaatataccaataattttatatatgtttaagtgaatttttatatttcatattatttgtgaatgatacacatcgtcgtggaaaatttacaacgttgaagtaaattatacaatatagggtatttgtattaaaatacatttcatagaaggtgctttaaatttaaaaagttagcatgaatacatattaaatgtaaaagagtctttaaaatgaaaaatatttcacacttgtgggtttgatctaaaaatatcagtcgctatatgatatggctagacagatttgagtaggtataattttaatgaataatattgtgtgatattttagggtccaaaattgaatgtttctattaagtaacagatatttaaatgccaagcagaagctacactggcaaaacaagatttagtatgttatcttaagtgtatcctaaatcctctttcatcttatggagaagaaatacatgcttttagtttccagccactcctgtctatattcatttaaaataaactattatttatatcagatatgatgccatgtgagtccacaatttgtagtatagagaaataatttcattgaattattttggctgtttgtacctgagacctgattctgaatcatttatttttctatttaagttgtgctattttatgatcctacctatggctatgttcaaaacaatgacaaaatatattttaccctgatctttttttcattattatactttaagttctgggacacacgtgcagaacgggcaggtttgttgcataggtgtacacgttccatggtggtttgctgcacacatcaacccatcatctacattaggtatttctcctaatgctatccctcccctaaccccccatcccctgagaggccccggtgtgtgatgttccccgccctgtgtctatgtgttctcatcgttcaactcccacttatgggtgagaatatgtggtgtttggttttctgttcctgtgttagtttgctgagaatgatggtttccagcttcatccatgtccgtgcaaaggacatgaactcattcttttttatggctgcatagtattccatggtgtatatgtgccaattttctttatccagtctatcattgatgggcatttgggttggttccaagtctttgctattgtaaatagtgctgcaataaacatacgtgtgcatgtgtctttataggagaatgatttataatactttgggtatatatgcagtaatgggattgctgggtcaaatggtatttctggttctgtatccttgaggaatcgccacactgtcttccacaatggttgaactagtttacagtcccaccaacagtgtaaaagcgttcctttttctccacatcctctccagcatctgttgttgcctgacttttgaatgttcgccattctaactggtgtgagatggtatctcattgtggttttgatttgcattcctctaatgaccagtgataatgagctttttttgatatgtttgctggctgcataaatgtcttgttttgagaagtgtctgttcatatccttagcccactttctgatgggtttttttttttcttgtaaatttgtttaagttccttatagattccgggtattagccctttgtcagatgtatagattgcaaaaattttctcccaatctgtagtttgcctgttcactctcatgatagtttcttttgcagtgtagaagctctttagtttcattagatcccatttgtcaattttggcttttgttgctgttgcttttggtgttttagtcatgcagtctttccccgtacttgtgtcctgaatggtattgcctaggttttcttctagggttttgatggttttcggttttaggtttaagtctttaatgcatcttgagttgatttttgtataaggggtaaggaaggggtccagtttccgttttctgcatatgactagccagttttcccaacaccatttattaaatagggaatcctttccccgttgcttgtttttgtcaggtttgtcaaagatcagatggttgtagatgtgtggcattatttttctggcctctgttctgttccattggtctatatatctgttttgctaccagtaccagtctgttttgcttactgtagccttgtagtatagtttgaagtcaggtagcatgatgcctccagctttgttcattttacttaggattgtcttggctatacaagctcttttttggttccatctgaaatgtaaagtaatttttcctaattctgtaaagaaagtcagtggtagcctgttggggatagcattgaatctgtaaattaatttggacagtatggccattttcactccactgattcttcctaaccacgagcatgaaatgttttttccatttgtttgcgtcctttcgtattttcttgaacagtggtttgtagttctccttgaagaggtccttcacatcccttgtaagttgtattcctaggcactttattctctttgtagcaattgtgaataggagttcacccacgatttggctctctgtttgtctattcttggtgtataggaatgcttgtgatcttttcactttgattttgtattctgagacttggctgaagttgctcgtaatgttaggggcagccagagagaaaggctgggttacccacaaagggaagcccatcagactaacagtggatcactctgcagaaaccctacaagctagaagagagtgggtgccaatattcaacactcttcaataagggaattttcaacccagaatttcatatccagccaaactaagtttcataagcaaaggagaaataaaatcctttacagacaagcaaatgctgagtgattttgtcaccaccaggcctggcttacaagagctcctgaaggaatcactaaacatggaaaggaaaaaccggtaccagccactgagagaaacataccaaattgtaaagaccatcgaccctatgaagaaactgcctcaactaacaggcaaaataactaaccaacatcataattacaggatcacattcacacatgacaatattaactttaaatgtaaatgggctaaatgccccaattaaaagacacagactggcaaattggataaagagtcaggaccatcagtgtggtgtattcaggagacccatctcacatgcaaacacacacataggctcaaagcaaagggatggcggaatattttccaagcaaatggaaagcaaaaaaataaaaaattaaaaaaaataaaaaaaaaaacaggggttacaatcctagtctctgataaaacagactttaaaccaacaaagatcaagaaagacaaagaagggtattacattacataatggtaaagggagcaacgcaacaagaagaactaactattctaaatatatatgcacccaatacaggagcacccagattcgtaaagcaagttcctagagacctacaaagagacttacactcctacacagtaatagtgagagacttttatactccactgtcaatattagattaacgagacagaaaattaccctgatctttaacattccaggcaagtatgttttcagtcatacatagtacgtgaatctgttatattttaaatccaagcttttggaggacaaatgatttcacagttatacaactcagcctctcccagactcaagtctctcacttgatgcagtattcccaccccatcttcaataaaagaagaaagcatgaaacatcgcattgatatagggaaagtatatctgagttttctatatagcatataaagaagtaaaataactctgtgatttgtgatgagatagatttagctgcaacaatgaggtctggatattaatattggattaacttcctttgagattgcaacttccatgtggcattcagcactttccttgttttctcatatgtaggccgagaataaaattatcctgtttctatttcccaacatgaaaggtcttttaactgtttgaagacatatgtttcatgtgaaaccaaggaattgctactgcaattttgtaagacagaagttagcaaacttattctgtaaggaacaagatagtaaatattataggctttgcgggccatatggtctatctcacaactattaaactctgccatttttttttttttttgcaaaagcaaccatagacaatatgtaaatgaatgagtgtgattatattccaataaaactttatttttaaactacaagactagttcttaaaataaaatttaacaaagaactattatatgatccaataattccacttctgggtatatacccaaaataattgaaaacaggtattcacacagatatttgtacacccaagttcatagcagcatattttactgtagagaaaaggtagaaacaaatgtacactgtgtacactgaccaagaatggagaaacaaaacgtggtgtatccatacagcagaacagtattctgctttaaaaaggaatgaaattctgtcacatcctaaaatagggatgaactttggagatattccacctagagtagttaaattcttagacaaatagttgcatggttgccagggaccagggaggggtaggggaaatgagcagttcttgtgtcattggtatagagtttcagtttagaaagatgaagagttttggagatagatggtggtgatgtttacatatccatgtgaatgtatctaatgccactgaactgtatacacttacaatggttgaaatattttgtatattttcccacagttaaaaaagacaagcccatgtgcccaaattgctgatataaatctgtattcctattagtgagcagtaatgagccatgtttagtgcagctgatatggttaagatggaacaattgcatgtaatgcaatggtgggtaacatctaataaaaattggtactcaccaatttccatttccattgtggatataaacacccttcacattatgaatcatgttatttgttatttgtgtacttacttattaaatcacttttctccatctctctcacctctatgactctgtacatgtacaaacaacatacacactgtgaacttctttagaatgacagttacattttcgttacttgattcattgtttggccaagtagatacccagtaagcataactagcaagtgaataatgtatatgtgatcattttccttttcaaaaaccacttcttatctctaccacaccaccacacattattatatgctacacttcttatataaaacaaaaaagaataggccaggtgtggtggctctcgcctgtaatcccagcaatttgagaggccgaggtgggcagatcacttgaggccaggagttagagtccagcccagccaacatggtgaaaccccatctctgctaaaaatacaaaaattggccaggcgtgttggcgcatgcttgtaatcccagctacttgggaggctgaggcaggagaatcactggaacccaggaggcggaggttgcagtgagctaagatcatgccactgccctccagcctgggcaacagagcaagactctgtctcaaaaacaaacaaagaataaataagctttaataaactcttttgcagaagagttttcatttttaaacatagaggaaaaagaagatgaggatgaacgatagtgatgcccagaagagaaaattgtgtaagacaaaatcaattgaccaggcgtggtggctcacgcctgtaatcgcagcactttgggaggctgagacgggcagattatgaggtcaggagttcgaaaacagcctagccaatatggtgaaaccctgtctctactaaaaatacaaaaattagccgggcttggtggtgcacgcctatagtcccagctacttgggaggctgaggcagaagaatctcctgaacccagcaggcggaggttgcagtgagccaagatcacgccactgcactccagcctgggtgacagagcgagactacatctcaaaaaaaaaaaaaaaagattaaatcaattttagattgatatagagataaataattccctaagtacaattaaagcaaggatcagaccctgatgagtaaggatgatctaacaaagggctgacaatataaagtgaatgcgattgtcaccaaataaacatctcccaagagctttgggacaatcttcagctaagcatattctgcactttacatcgttctgccatatgccctatgtagcttttcatcctccagaaatttgaatagcacacagtattttttggcaccgagtaattgtggaacttaaacttcctacaaagagagaagctgtttcagtcagctaagtgaccagttagtaagcaacttctattctcttagtgtcgatagggttaaagacagtcataagctccccaaacccttggccgcctcaattttttcatttaaatacttatcttcttatcttcatctattttttagagtcacacataaactctgtctatgaggttcttaaagacctggacaatatatttaatctctgtatccttaaatctcaccatgatatctcaaagatggtagataaaactgttttccctcacttctctgactccataccaatacttaatcgatcgggaaagttttataaaccatttaccgttgaatataaatatatatacacacacaaacatatatatatttatatatatttatgtatatatatatttatatatctatatatatttatgtatatatttatatatatttatatatatttttatatatttatatatttatatatatttatatatttatatatatttatatatatttatatacttatatatatttatatatatatttatatatatttatatatatttatatatatttatatatttatatatatttatatatatatttatatatttatatatatttatatatttatatatatttatatatatatttatatatttatatatatatatttatatatttgtatttatatatatttatatatacacatatttatatatttatttatatatgtttatatatatatatatatggcactatatatcagtgagcaaaggcatcataatctttatttttatttctgtattcatttattcaacatatagtaattctgatcctgtctcaaaaactctacagaaattaacaaagaacacattgtttctgcctttttggagctgaatgtttagtgggggaaaatgtattttaaggcaataatcatatacatgagtgtatatttacaagccgcagtaggtgctatgaatgaaaagtataaggagctatgagatattctaacaaaaagaaatgctgcagtctagagactgagagtaattatctgtgaggaaaagtattgaagcagagacctgcaactcagtaaagagtgtagggagtcacatgaacaaagtcttgagatgttggtagagatcttggaatgttcgaaattctaaaagaaagcccttgtgtatggggtatggtgagagagggagagcgtggcaagttttacgttgtacaagtcattgtaggccacaaaaataagtatagattttatctaagtgcaacggaaaaccattacaagtttattttttgattcttaaattttgttttacttatttatttatttcaagacacaatctcactctgttgcccaggctggagtgcagtgacatgatcacggctcactgcagccttgaactccttgggctcaagcaatcctcccatatcaccctcctacctcagcttcctgggtagctgggactactacaggcatttgccactatgcctggctaactttaaacaattattttgaagagacagggtcttgttacgtttctaagtttctaaggctgatcttggattactgggcccaagcaatcctcccgcctcatcctcttaaaatggtgggattacagatatgagccacctcacccagcaaggtagtgacataatcattgtttttgctgaaaacaatgtactttagggaacctccctgaaaacagaatggccacttagaataccaaagcatagaccaagccttgagatggcaatggaagtggaaataaacatgtctttgatacttatgttaatggagctattagtagcaacttttgacagatttgaaagtggagttgaaagacagtgaagtgtcagggatgatccctgagcatattagataatattgagctggagaacagaaaagaaggggcagatttggaggtggagacctttctagatttatattcaatttgagatacatctgaaacatctacatgaaacgtggatgaaatatctgtgaccaagatacatacgtgggatacctaggcatgtaaataatatttaaagttatgtgagtgggtgcaataacctaaagagagactgtaggtagaagattgatcaggacaaatctttgaggaacttttttttttaattattattatactttacgttctgggatacaggtgcagaacgtgcaggtttgttacataggtatacacgtgctatggtggtttgctgcacccatcaacccgtcatctacattaggtatttctcctaatgctatccctaccctagccccccacccccaacaggcaccagtgtgtgttgttcccctccctgtgtccatgtgttctcactgttccactcccacttacgagtgagtccatgcagtgtttcattttctgttcctgtgttagtttgctaagaatgatggtttccagcttcatccatgtccctgcaaaggacatgaagtcatcctgttttatgaggtacttttaatgcatttagtgactgggtaaggaataaccctgaaaaggagcacaaaaaccatcgaggtatgaagaaagccaggagatgtagtttcacaaagcagccagtggacagtaatggacaccagcataagcttaagacagcagtgatagtgttcatcagtgctgaaaactcattggaagtggctgaccatatgttgattgcgaatgcaatgccttctcccatctcctattgcttttcactgtttccgtcatgtccagagtgaaaacactggggaggcagaactgtgtaccaagaaaaatgttttgtgtcagaggaaacaagagctcattaatttccttttgacccgcatggataggaatacgataagcaggagaaaaataaaacctgctaaactaggcaaataaagcttaatagaaaagagagaaaatattgcttacaaagggaagaagacatttgccacaatattagctaaaaagagagtgaggaaaatccacatttaccatttttattatgtgtttccaaagtcgacattaagtgaatattatcactttgaagacagagaatagattgtaagcagaagaggaagtgggattttttaaatggcatatatttaaatgttgaaaaacccatttccaatactcccactgagatatatgcaataaaaacactccgcaatcagtaatatacatgtgaagctcctaaaaatcctccattgagaagattctataaaactataaagtattattatttctgctatcagaaaataaacacatactttctaagaacaagatgaagaccttaattcatcttcccaggaatatacttgtgtacttaatggttcaaggcgtttgtgatgcaaaaaaagtgggacattatgtacaaaatagttttaatcagaaaatgaaggaagtttggtatggtatggttctagggttgcaagttttcctgcaaaaagggagtacttatggctaggtgatgcagccaaggaagcatctctgaggacaggttatcctggctcctattccaaaatatttaggtctccttgagtgttcgatccttgaaccaaggacaagaatagaaagaaataaaagccacttgtataaaggttgccttcattttgtgtcgaatattgacaggagaaagccagatttgtagcttttccagggataagtgagtctcagacacagttaagagcttggctttggaattagattgacctgagtttgaatcgtggctccatcaatctctgattgtgtgaatttttggcaagttttagctgaacctcaattttctcataagtaaaataggcataatacagctatgattctgacccttgccattagcactctgagctacttgtcagtgtatcctggtctcttcctcaagcacttttccactttgttatttcaagattctttgaaattatgaacagtagctcttgatcaccaaacaaatgggagaccatagattcaaaggaacattttagtaggatatttgataagctttgtatttttttgtgctttgaaaattagagtagatttagatttaaggaactataaagctatatgtttacaaaactttattcagttgggcagttctgactcagtaactgaaataaaattgatgaaaacaaaacatatgttttactgttgtgttcacatttaaagattatttaatgcataaccaaaataggttcagcaaatgtttatacatacatgtacttagatatttgtaattcttatggtagagcatgggaatgaatgagaattctcctaggctggaataaaactaatgtctaactaagaattggcctttcacttcacgaatatatatcattatatataaaagattcatcctttgttaacttatttgtttagcttagtactttctaagtacttttctatcctgtcttggtccctatataagaatgatactattataaaaatgaacatcctattatttcataatgattagcatatcagcatatttaagagcaatgcctatatctttaccttcattattattttcatgtttaaaatcctgataattctagaaaaacaaggttgtaattatccattcataataaaagtcacaccaagttattcttgataattaacttggcatagtggagtgcactgagcaattaataattaattacgtggttactagctcaaattttattgagaaccaaggagttaaaattaatagtattgtgtttgcaatgagttaattactttgtttctttgtttttttttttggaatagtgccataattagtatcctaatagaaacagaatataaagtgggtttctgagtgcttgcttgtcgaggtgtgtaacaacatatattttaattataatttgagtcactaattgttgtcaaatacaattttaatttcttagttcagagattaaaagatatgtaaacagctccaaaaaagaatatgataagatggtttatacaagtaaataaataactatatgacttcagaagttttatttaacaacagttgtataagtgttttaactaatgttaacaatgccttttttgtaaatctcctctaccacaaatatgagataaatttaagaacggcattttcattaaatattgattattaaaattcatatataagtattggctgtacctgagcatttacagtgaaaccatgaaggactggcaggtttggggctgtttgataatatccttccttaatctttcttcgtagcatcattgtttaattttggctgaccacaatcacttatgaaaagaaacagctcaaataattagtataacctctttctcttcataaaaccttcaaatcaatgtggtcataattatgaaagtgtaagattataaaatcttctcatttaaatatacatcttcatattagcagacttggctaatttcttcatttatccttgacatccacacttaaactctgtcaaactggtcattcatagactcattattcattcaacaaagattagtgtgaccctactatgattctgagggctagaaatataaaactgaataacatataaaccctgatttctgtatttatatatacagaaaggaattatgaactcacagttttaatgcacagtgacgagtcctcagttcatgtctgccttgggagctaggcatataccaaagcaggactgtctaacacagtttgggggtctcagtctggaaggatccgggtgagatgatccttgaattgagttctaaaaaatgaggagaaattatccagataatggaaagtttaggagaaattaaccagataatggaaagtttaggaaagaaacactatttatatgtcaaggacaaagtttgaccaaatgtgtctctgaatctaactggctttatgtaagataaaattaaaaaataattgtcactaaggtttttcacatctgcagcaactaccatcatatctggctcaatatttaaaagaaatacttaacgatttttggcatttattgctactataatagattgtgctatttaaagagaaattctagatacatgccaaagtattttcaggtgaagtaatgtgattcgtgggttttgttttgacaaacttccaaggaaattatttttaatataaagagcaatggaggaagattaaacaagattcgcaaatgttgataattgctcaaggtggtgacaggtgcatgggggtccataatatactgttctctttacttatatatgtctttgaagattttcatgatgtaaaattttaaaatcagaattacagtaatacctctttctttgacaatcgttttcaaacttggttcaacaactgaatttaaattacctacatggctataaaaataaattagatatcctggttatttggtctggggtgggtcctggccatatctgtagggtgtgtgggtgtgtgtgcatttagcttcacatttgactctgaagtacgtggaaaaccaattctgggctctacatatgcaattccaatgcctgacattaggtggtgctggttgtgagccatgatttcaggtttgacttgtagagttaacagaagtgatatcaccaccgatcccacagaaatacaaactaccgtcagagaatactacaaacacctctacacaaataaactagaaaatctagaagaaatggatacattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcataccgaatccagcagcacatcaaaaagcttatccaccatgatcaagtgggcttcatccttgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaaaggtattcagttaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtgatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactagctgacttcaaactatactacaaggctacagtaaccaaaacagcatggtactggtaccaaaacagagatatagatcaatggaacagaacagagccctcagaaataacgccacatacctacaactatctgatctttgacaaacctgaggaaaacaagcaatggggaaaggattccctatttaataaatggtgctgggaagactggctagccatatgtagaaagctgaaactggatcccttccttacaccttatacaaaaatcaattcaagatggattaaagatttaaacattagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacagggaacctacaacatgggagaaaattttcgcaacctactcatctgacaaagggctaatatccagaatctacaatgaactcaaacaaatttacaagaaaaaaacaaacaaccccatcaaaaagtgagcgaaggacatgaacagacacttctcaaaagaagacatttatgcagccaaaaaacacatgaaaaaatcctcaccatcactggccatcagagtaatgcaaatcaaaaccactatgagatatcatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaataacaaagacttggaaccaacccaaatgtccaacaatgatagactggattaagaaaatgtggcacatatacaccatggaatactatgcagccagaaaaaatgatgagttcatgtcctttgtagggacatggatgaaactggaaaccgtcattctcagtaaactatcgcaagaacaaaaaaccaaacactgcatattctcactcataggtggggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctacacaatgtgcacatgtaccctaaaacttaaagtataataaaaaaaaaaaagttcgttcctcttgttagaattttcatacaaatgcaagactccttattttcaaagagaaaacaaaattttatataaactaatacctgagaagaataggaaaaattaatgatgtatgggataggtactgataagaacctcttcttttgtgtacattgtgataaactaatgtttaacttgagtcgatgtgctggaaatacttgttaaattttcaagaattttgagatctgttaaacacaaccattatcaaaaattaaattatggtaacttacattaaatgaaatatattgttcacaaatgtactagatgcacaaaagtcatcactacctaattcttttattatatttcactattatctacgggtttgttacctgtataatggaatgactgtataatggtgtagtgctaacttcatgtttggtgacattataatgatagcttaaaattaaacatactgggaatattcaaatatgtccttcctctcaggggatctgattgttagacatttaccagcatagcactgtcttaattaacatcatataattgtcttttatccttaagatgttgagccagtaaatatcacaggagagtttgttccttaggttttaatacttgctttaccagtttactgtagcatcatgtgaaaccagcttctagaccagctgtctttaattggtatgtacccaagctaatccttgtcaggctatcatcaacccaagcacttttgaagttatttttattattacgctacagaaagattttatggcctttttgctcttttctttaccctagccctaggatcatataatttcatctcctatttattcctatttatttccttatctaaaatcttacttaactagcttgcttgcctgcctgtctgcctgtctgcctgcttgcttggtttttctttttttctttcttttctttacttctgctttcctttcctttcttttgtttcttccttccttccttccttcttcctttcctttccttctgttccttttccttttccttttcctttgcgttcctttgctttccttgctttcttcgcttgctttcttttcagtaccacaaaaaaactaacaataacaaaaatattgctacaaaaattgtgacctcccaattctatcctcatttcacggacccataaaatgattatatatctatgccaatgcgttctaactacatgatattattattgatgataagagaatccaaccctcaagaaatgaagtattataatgttttagaacacacagaagcatttttaaccaaaatgttccatgtgattttatagggtgcatgttttaccttttcttatttggaaaagtagcaaaagtattaacaaataaaataagttacatactctttgtatataaatctttcgtgtacataataatgccatttcccttctagtgcttccattattgaaaaaaaatagacatatagcaacgtgctagacattgaagttaactgttaaaaagtcatcagagggtaatgttaaaggtggtatttcaggtaataaagcatatgcagaatgattctattggctttatttccaacatgagtgttattagtaccaaggacactgaagtttaaaggaggggagtgatgagactgatcattactttgtcttctgtaacaggacttaggtggcccagagtgatccttgttggttgattggttagttgaacttctatttttgttactaggcctgcagatctgtggaatctccagagtgctgtgtaatgttacataggccacacaccagacactgttccctgaaggactgaaggtggaattggaacaatatgtagacagttcttgttgcagttaccaaggaaatttggttaggattcaggcctccatgtcagaaaaggaagtctattttatgtgctagaaaaataaccctaatcatcttatcttgggtctctctggggagcatgatgatctacctggtcttgtaaactgtatagaaccggctgggttgagacacatatgtctcataacagagcttccacttaaggctataaaatagtggtccctctattgggtatatgccttatggaaaaatatacgttatgctggtacctattataaaaaccaatgcaaaatgattagagatttctaatccaagtgttatcctcatctgctcccaaaatacagcaatgaaaaaatagaaaataaaaaaggatatatttacagaactgtatttacagaaatatatgttgatgacaagataatcaaatacatatcaaatcatgatgtgtatttacagaaatatatttacagaaatgtaaagcagagaatggggcggaagtccctgacagacttgacactgaaccacaaaacaacagtggaagccaggaatttggatgctgcgggatagttgggattaaaattgcttcaagcaaggtgtggaactggagacaaactcagtattcaaaaccagaggctgggctgtggtgcttgcattcgtgaaagaaaacctggggaaaaagtgcttcttcaggctgtagcctgacgctatggcttgcctaaacttatgggcctatgtaggtgtaagaataaagacatagccttgctgctgggaactgtgttgcatctgttctcttgcttgatgaatggattgaaattatccccagtaacattgcagtgcaagaactttaaaccttaaaggggtggctggagaccacgggacgcgatgcacatgcaactactaaatgctagatgaggatacctgaggagagagaacaagacacaaacgtgaacatggacctccaatagaaatgacaatcgaaaacatacatttatcttctctctctcccaaattgttcaaagattacgctaagggaataaaaacaatacagtcataaaatgacaaataaaatggaagaagagacatctgcacagacatatcaagtcaatgagatgaaaattaggacaagtaagccaatttgtttttcaggatcccagaaaaacttgtggattgaagacgctaggtgttttagaaggccatatattcccgagaggggctggaaataaaggggttgttttgaatcccttaaaaggggcaattacatttcatgtccccagctcagggtagttaattagacactactcctctctcatcccagcagacgtgagtgagtggtttgctttctggtgaggctgaaacaacttttggcatttggacaacaggattagttgatggaagagagagccaccatactgaaaatacaggattaagttaaagtcaacatatttaatggtgagaccagcagtccctcttcaccttcttggctcttaagtttctatcctctgggcagtagattataaatttattctcctgagagcctacctgcaatacgaaaactatttttagtcaagttttattgctataacaaaataccatagactggatgccttataaacaacagacctttatttctcaccgttctggaggctgggaagttcaagatcaaggcactggcaggtttggtgtctggtgaaagctcatttcctgtcttctcactgtaacctcacaaggcagcaggtccaagggaactgtcttgggcctcttttgtaagggtactattctcattctggatggctttggccttatgacctaattaccttccaaaggccccacttcctaatgtcatcaccttgagggtgaggatttcaacgtataaattttgcaagaacacactcagatcatagtaacctacaattaatgatatgtaatgatccaccagtgaaatagccagatctgtgcctaatgaccatatattgaagcccaccaagtataagccctacatacgcacaaggaatttccaaaagcatttaatgcctcagttttaagagacaatcaaggatttccagatatttgaacatgtctcaaagatggaagacagaaaccaacataaaaacaaaaagcagaaatattgggaaaaaaacaatagccacataaatgaaacagaaatctctgcagaaagagagacaaggcatagaccttaagaaaactttttaaagatagctataaaattattatctcacagtgagactagtcactgtattcataagaaagaacaagagactatagaaggtggtatttccgagaaagataagggttatttaaattaatagtatagcaggttaagtttttaaattcttaattgtataaatttatgggttaccagtgtaattttgttatatgaatatattttatagtggtgaaggcagagcttttagtatatccaccactggaataacatacatggtatgcatagcagttttagagcaatgaaactactctgtgtgatactataatggtggatacctttcattatatatttgtccaaacccatagaagatacaacatcacaagcaaactctaatgtaaactatggacttcgagtgttaatgatatatcaatgtatgtaagtcagttataacaaatgtaccactctggtgtgggatgttgatagcggggtaggctgtgtgtaatgaggaagggggccagagagtatacgggaaatctctgtactttcccctcgattttgctataaatgtaaaattgctttaaaaaatcaagtctattaaaaatgaagagcagaaataaaagttcaaaagtagaagataaatttgaagaaatatctcataaagcagtataaatagccaaaagcatggaaaatgggagagtataagaatcttagaagatcattctaggtaagtgtttcacaaatagaggtgattttgtcctgcagaggacgtttgacaatgtacggagacctttttcgttgtcacaaataaggaaaggatgtactactggcctcttgtgaagagtgacgcaagaggaatgcaccatgcagccatccacaaccaagaattactcatttcaaagtgtcaatagtgtttatgtttagaaaccttgttctatgtaatccaacattcaaataatagatgttaaaaataaaacagaagagaggcaactgtggagagaaaattatcaaagaagtgacaacatcagttttcttagaactgaagaaaatgagtgtccaggtttaaagggcttactaaatgcccagcacagcaaatgagctaaaaatctacaccaaggctcatcatcataaatttttacaaaaacaaggacaaagagaagttcacagatcagaaatcagaatggctttggacttttcagcaatagccatggaaaatagcagaaaggaacacttcctttaaacttctaggaataattaactttggctttgatttcatatcctatatgaaattatgttcacaaattctgtgatgctcttctattcaagagttacagctaaatgtccctgtcattgagtgtggactagattcagtgactcttttgtgatgatatgtcatttccaagtgtaggttgtagaaagactgtggtttatgtcttgtgttctccatccacgcctatctctctctgtgtctctctttctctctctctctctctctctctctctctcatgcattgcttcttctgtgggaacacatgtcatgagcagccctatggagatgcacgtatgctgagaaactaaggcctcctgcaaagagccacaagaatgagcttagaagtgcatcatttaacaccagacaaatctcgagaggctgcaagcatagacaacagcttaactacaacctcataaaataagctatgccagtcccaccctgctaagccactctcagattcttgaccttcagaaactgccaaataataaacatttttgtttttaagctgctaaattttggaatgacttgttattcaacaatatataaattgtacaccctgataaactataaattgtgcggagaaaataattttcagagatagccttatgtactcccctaaaccttttttccccagaaatctattttcaaaaatatactctaccaagtgaagaaagaaaccaagaaagacaaagaatgtttagttgtgattggagatcagaaggagagtgttttaggcatgattcgccttgttatgctgcaataataagcaattccaaaatattagtggctagaaacacaaaggttgattttgtatctttgcaacatatccaacacaagtcagtcaagggttctgatcattgtagtcactcaggaatctaagctgattcagtctctagtattctatcattctaccgtaacaataagaagctttagcgttcaccatgtcagtcaaaaatgcgtggaaaattttaaactgactcttacatgcctctatgtaggagtgatatatgtcattttcatttcacttcatcatccaaaggaagtcacgtggtcatgcctaactctgaggggacaggggattataatcactaatatttttaagagaggtaagagaattaggaaaatattggagcattagtattacctgcaaagcctaggatccggaaaacagagaacccaacgtgggaggaagatgcaaagtggtgccagaaagatggtggaggagatcctgtaacaacagctgtataacagttgtagagagaaacctgtacagattggagaagaaaatagtgctccaggaattttgttaccaagaaaaaaaaaatctaatgtattcgaatgtattgagaggtggtattcttattgtgtaagagtataatatatgacatgtatgacagacagaagtaccatttaaaattttattaaacataagaattagatccctatctcacactgtacataaacataaaaatggtaaattgatggattgcctaaacatgaaaggcaaagcattaaaatatataaaaatattttggggcatgtagggcaaaagaggtgtcccttaagcaacagcacaaagcaaaaattgtaaagaaaaagacatatatttgatcattttaattaaaaacctgtacaatgcaaagacttcataaacaaagaaaagacataggctcagatagtatatttgcaatactaaaacaataaaggatttatgtcataatttaagaaaaatatttacctatcaatagaacaaaataaaaataacctaacaggaaaatatttttaaagtttaaaaaataatagacagttcacagaacatctgtatgtcaaatacacttatgaatagatgctaactctcatttattattggaaaaattacttcatattagtcggttttcatgctgctgataaagacatacatgagactgggtcatttatacaggaaaaaggatttaatggacttacagttccacacagctggggaggcctcacaatcttggcagaaggcaaggaggagcaagtcacatcttacatgaatggcagaaggcaaagaaagtcccctttataaaaccatcagatctcatgagactaatttactatcacgagaacagcatgggaaggacctgcccccatgattcaattacctcccacgaggtccttcccacaacatgtaggaattcaagatgagatttgggtggggacactgccaaaccatatcgtactaagtgagataacgtactcccatcggactggaacaagtaaaaaataaaataagattgtgaaaggtcacaaactctcattcttgtagaaatttaagttggtacaaccaatttagagtgtaatttagcaataatctagttaaactgaggatggcatgtcctaccaaacagcattccagttaatcacattgaagatagcatgattgttctcaggcttccatattttctgttgaacggtaagttgtcagtctaattggcattcctttaaaatagacttgtttcctcttgatgattttcacattgtaattttgtctgattttcagcacttcaccggtctttaaatgattatgtaagattttcattgctgaggaggaaatcctatcacctcaaatactatcttattagttatattttcattttattttaccatgattttaaatgaattccttaaaaaattaggttagagaactaataaatgataaagagaaaaattattcttcatcctgatagctgttatgtgagggtggaatggtatggctggtttttttcactgtcattttgtaacttggaaattcttattttttaatacaatgacaatattttcatagttaaaaaacactaaaactaaaacaatagtctgttaatgacaaatttaagggcgatttcattaagttaaaaatccatgttaaggcattataagatgaataaatactccaaatgaaaacaaagtgaaggccacttttatttaccttttgtacatgatacttatttttcaacagttgtcatgttagaaaaagttgaaaaaataaaacaagatacacccccttttggcctctaaccttccaaaattgtaatgggtagacttcaaattaaatatctaattcgactcctttccacttctaccctcatagcattagagacatttggaaaaatgaaaaaaatatagtattttatggcagggtacctcaaccccagagccacagacccgtaccaatccgttgcctgttagggacccgattcgcaaagcagtaggtgagcagcagcgggctagggaaggaagcttcatctgtatttacagctgctcctcatcactccatttctgcctgagctccacctcctgtcagatcagcagccacattaaattcccataggagcacaaaccctattgtgaactactcatgcaagggatctaggttgcatgctccttatgagaatctaatgctgcatgatctgtcactgtctcccatcaccccccagatgggaccatctagctgcaggaaaggaagctcaaggctcccactgaatctacattatggtgagttgtataattatttcattatatattataatgtgataataatataaataatgtgtgcaataactgtaatgcacttgaatcatatggaaaccatcctccaacccggtccacggaaaaattgtcttccacaaaatcagttcctggtgccaaaagggtcagggaccactgttttatgggataagtgaaagctggatttgaatccaactctaccttttacttcccatgtgaacattaaaagatgacttaatgtctctgaatctttttttccttctaagtaataactaccttgcagagttattacttgaattggccataaggtaaagaggacaccaaatacagtaaataataacataataataaagaaaccttatgaattctattcagtgatatccatattgaggtatttaaggtgaatgatactgatgtcagcagtttacctggatatgcatcaaaaatatgattgattgatggatggatcggaggaaggaaaagatatgtgatcaaaacgagtatagtaaaatgttcatggtggaatctagatatatagatatcacttgtaatttttaaaaatgttattgcatttttgaaatttgttatgttaaaatattgggtgaaaattctgatgccctggccatgtcccaaatcagttgaatcagatctctggtgtattttttttttaagatccttggatgactccattgtacagcaagtttgcaaaccactattctaacttctcaccacccccttctttatagcttacaaaattatatttttaaatgtcaaatgtcacaatttcactttccttcttcaagaactgattagacttctagcttctcctatgctctcatcttgcataacgttcatttgcacgtggttaaaactgataggcaataaataataacccatctgtcttttcctgacccaacataactaaaaccttcctttcaaggcgaaaatgaactataatctcacagacaagagtagctatagacaactaattctttctggtctctcgtggtcatgggactattcaccactgccgtccctgctgtctatttggtggaccagccagttttactgtgacccataccatggctcttgagaagcatgaagctgccgaaatcgcagttgtagggttaatggaaaacatggtgaagtatagcttacatatatatacaattttggcacaaaatgaagcctaagaaattgtaccgggctgggtgtggtgactcatgcctgtaatcccagcactttgagagaccaaggtgggcggatcacctgaggtcgggagttcgagaccagactgagcaacatggagaaaccctctctacttaaaatacaaaattagccaggcatggtggcgcatgcctgtaaccccagctactcaggaggctaaggcaagagaatctcttccaccctggaggcataggttgtggtgagagaagatcacaccattgcactccagctggggcaacaagagcgaagctccgtctcaataaataaataaataaataaataaataaataaataaataaataaataaaagaaaaagaaattgtaccaggaagtggattgggaatgctctatatattctccccctccaagaagtttttttaatttattgtattgtgaaagatctgcagctatttattttgtgtggtactcttttgcaataaactacttctgcataaatgaactcaaaaactttgatattcatgaaccttcataatgttgatctagtacatcttgcccaactagcccttgggccattccttccatgccactggttgaaaaatatgctccccaccccagtaacatcagcatcagacctctgcaaccagaaagattccataggtaatgaaatccaaatgctggcatttggaagtcaaaccagtgtattttgaaatggaaaggcaaggggaagtgcatggagcaagtacagcatgtgctacaacttcagttcataccctccttaaaatactgtgcaactaaactgtcaattgcccattgatagagatagtatctttttcagctttacaccttccgaattcaacacactgctagcctcaggactaagcgctcaataaatgtttatcaaaagattgagtaaatgaatcagtggtgaaataaaatgtacaaacacatacgcttcatacacgtttaggaagcatttctagtgagctttgtggatattttatttcttaaaggttctttttctttccatgttcatgttattctttattttttaaaatgttgcttctgcttatttctctttctacggcagctatatttacttgcctgagagcacagcatatactgatgttaatcaaactttagatgaaacacctaaaatgatagaaaagaatctgctctaattaaataataaagcaacccctacaggtttagacatgtgccttccggtgtgggaaagaaaaaatttaatgaatgtagtagttttatgccaagaacatttccctcgtgcacctgtgttttaataagatagaatataaaatagcaaaaggggcccgacttttgtgatgatatttactcataaggtagtaagtcagatgtgatgacattttctttgacttagagctgctatacttgggtcagatttcagttcagtaaatttgcagtgaagttgtctttctaacatggtgtcatcctggaactgccctgctcccacagttacatacaggctagggagtgggtaggagtgggggtgaaatcctcttaatgtttatggtgtcagtagattcaaactaaaattagccttacagccatactcctaataaggggcccctggcatatttaattgatttaacaaatttatcaaaaatagataaactgaaatctgccttgaaattaattactgtatctctatttttataagaaaatattttggacccgttccctctgccttatgggtgcaactcccggcagaataggtcatgtctcctgaaaatagttcttattttctttactacttatgacctcttatagcctagaagtttttccttgctatttctagttgaaatgctaatctggcataatttctagttgaaatgctaatctggcataatttcagaactaattttctgttaatgccacttggaacatctaaattcctcctttttcaataatactatatttgtgtgttgcaaacacacacaaatcatactatatttgtgtgtatatatagtaaattccaacttataaaagtaaaattggaatttttttctttctttggaaaattattttataattgagaattataaatgtcacttttttaaatgctgcaacctttgagattggtttcaataaagtaaaacttagtaaacattaagaaaaatgatagcttgatatgttcactaatatggtaaatgaaaacttttatgtgtgtataggctcttgttaattataactaccttcacaggaaaaacagtcttgtggaaggtaatggtgccagtgagagaaaatagagaaagtagaatagtagtaagagagaaaatagaatttcccgtttagaataaagctaagtaaaaagtgaattgtttcagttttatttatgtatttgtaagtgtggtctcatgccatatatattcaaagatagacagagatcttaatctttaattttttatggccaaagaaaatgagtcccatgtaaaagggacattttcgtaagctgatctcaagtggtgtattttgatttgccgcagcagcctatggaagaaatatcattttggctgcctaagaagaaaaatgtcatacctttctattttttattcatactccgcatatttggaattcgtattctcaccatacttttgggaagataacacgaaattgccttacttgcctcgaaatcaaaatctgccattcgttttaaaataaaatggctttttcatctcattttcctttagcagaaaaaagtaagttaaatttttttgtagctgtgttaagtgtactgttcctccctcgttgagaacgaaacaaagacatatgattccatttactgtaattgttttggtttgcccaattacaatagcagtaaaatcatttacacatagtaaaatgtttgagccttaaagggcaagaagactaaatttagctgaagatatacaactttcatgtgccaatgaggaaatgtataaaatcagttatacatattttcctcattcatagatattgaaaatattcatatatgtgtacatgtatttgataacttaatattttctaaataacagaaattatatactgtatatatatttggatattatgattattgttattgccaccattgagcacttactatgggctcagaaaacttcactgtattatttttaattcttataacaaccctgtgaaatatatattatgcctatttcacaaatgagaactctgaaatcaggaaattaaatcacttgctgaagtttacaaagcactgttaggcaataaaacagaatttcaaactcacgtttgcttgtcttcaaattttgtatgctgtacaacctgattgttttactacttgttcttaatttcaaaaaaaatcttcatactaaaagatgatactttgggagttctaaagaacatgtttttggccgggcgcggtggctcacgcctgtaatcccagcactttgggaggccgaggcagaaggatcacgaggtcaggagatcgagaccgtcctggccaacaaggtgaaaccccgtctctactaaaaaatacaaaaaattagccgggcgtggtggcgggcgcctgtagtcccagctactcgggaagctgaggcgggagaaaggcgtgaacctgggaggcagagcttgtagtgagccgagatcgcgccgctgcactccagcctggttgacagagcgagactccgtctcaaaaataacaaaacaaaacaaaacaaaacaaaaaaaaccatgtttcttttcagaaggtatactcatttgaagtggataccaattatttgtattaaaattacttatggataaatttgaatctgcaaaaattaagtgcaacattattttttggcacctgttataggaggtaaaaatggtgattcaatatagtttctacccttagggagcatttagtgtggtttagacgtaatgacactaatgtaaattagagtagaataaattctttaaagcaggacaaaaggagtgttaaagactacaaagtttcagttatggaagataaaattctggagatctattatacagcatagtgcctatagctaataatgctgtttcggacacttaaaatttcctaagaaatcttatgttgtgttcttaccaccagtaacaacaataataaaggggacaagaggaaattttgagtgatgacagatatgtttatagccttcatggtggcgatggttttgtgggtgtatacttattcccaaactctttgattttatatatatatatatatatatatatatatatatatatatatatatgatgaaactctttgagatatatatatatatatgtaaaatatgtacagctttttgtatgtcaatcatacttcattaaggtggttacaaaaaagaatcaagaaaaataatcaccctaataaaaagagtgttattaaagaggggagggattacttctaattggtagtatcagaaaggttctcatggaggaaggtatagaaaaatttaggacaatataagcaacgatactttaagaaaaggaataatataaacaaaaataaaccaaaagatgaagaaccaccaaggatgtttctgaaaaatcaagagaaattccattttgatttgagagtatgaggtacttgtcatgatatataatgagaagtgtctagaaatatgttattttgagcaaatgctgcttagaaaggaggttaggttatttattaatccattcctttgaaatataaatttcatgatcagaaacacgtgagtgtaactatccaataacaacatgatttatttccaagaggatagtatattataggagaagtaggattttttctctttcacaagctaatacagtgtttactgattcaaatgacacttaaaaaaaacaagaaacaaaaaacatacactataagctatccttattcagctatgttattgtcttgcattcctgattagaaacatacaagttagactcccaaagtctcagttttctcatttgcaaaatgaataaaatgatagtacctaccccaaggtgctgtggagtatatttaatcatgtacttaatctgaagttttaattagagtgcatagcatatatttgtggttgcttttgctcctatttctgggtaaaagttcctacacctattatatatgttttgtgtttgaatgaagagaaaggcatcattatttcaaatatcccctctagccaacaaatgaaagctaagacttggaagctaggatgtctaacaccatatcctcttcatgtggactatatagtagaggatatgtaaattaagactcaattaaatgctcacattttataaaggagacccttgaatatatcaaatcctcagagagtatgtcagtttaaacttattaagaaatttaaattatttaacttagcctgctgagtcagtttctgtagctgatttctccaaaaggtcttggtattaaaagtagcattacagatcactaatagcaaactatttctgctactttgggtatttttacagggtgctaattgtgccaaatcaagacattgaaattgcataattttaggttaatattagcataatcctacatattttttcagaagcagtgcaggaatagtacaccctgaatatttttccatcatgatggaattttcaaatatcacaacctttacattgtcagttgtctgctggaacattatattgtgtcaaagagatttataaaagagaagggcaaagaaaatttgcggagttctagacaatagtaatatcagggacacttttgctttctttgttattactaaggagttaaataatcagataccaagcataggtaaagaaatgaatctctaactatttgagtacttatcaatttatctcaaggatatttacggtgttttcccctaagccaaaatagagtgcttaattaaggtccccttagccccctaaaaatcactcaggccaagtttctgatatgtgtgtatacttatatacatattaaagtatatgtatttttgtgtgcactttcagatcaaaaagtcctcgtttatctaaagcaatttcagcttattgatgaggcttttctgttacagcgtcctcctccacagatctgcctgtctagagatttaagcccaataagagtccagcaaagtttaaacaacactttagaaatctaaagaattttaagatttattttaatagtcttagtgataacctgaattgtttgtgagttcttacaaataatgcaatcaacatttaagtaattttattatttttttgtttgtataaatttaaggtatacaagtacatttttgttacatggatatattgcagagtggcgaagtctggttttttgtgtacccatcatgcaaatgatgtaccttttctccattaagcaatttcctatccttcgcccccatcccaccctctcgcccttctgagtctccagtgtctattattccacactctgtgcgcatgtgtacacattatttagcttccacttgtaagtgagaacatgcaatatttgactttctgtttttgagttattccacttaagatgaccaccagttccatccatgttgctgcaaaagacatgatttcattctttactatggctttgtagtatttttcattgtgtatatgaaattgtttattccatacgcaatttgtgtgtgtgtacatatatatatatatatatatatatatatatatatatatatatatatatgcttagacttagaagctaggatagacacacaatggaatactacacaatggaatacattcattcacacacatataaataaaagaatatgtggagatatatctccacatattctttatccaatcatctgtttttaaataatgctattgacttctttagggtgaattttatcaatattgttttggtttaaaacactcaccttaaaagagtcacagtccctaaatgtgcatcctcatatttaaattaggtctcagtaaatttgtgcaaagtgtattctttttaggatggtgttgaacttgctaaattatttatctttaagaatcatcattttgtgtcttttattaatgaaaacaacaattatgtgattgctgatatatttggaaaatgatttctgatgtagattgatttttttattctaaattctgtgtcggtattaaaaatttatagattactaactgtattaatatcgataatactaaattttattgctatttataacttggagtgtactttcatcctcctgaaaaagctgaatgaggtaggcagtattattctgggtttatgtgtgagataactgagactcagaggtaaaatagtgtatccaagcattcatggctcttaaatggaagatataaggggtttgtgaaattactcatggacttttttattcattcattcagttattaaaatgtattcaacatttatcatgtaccaggaacagcgcttagtaccaggaattcaaaggtgcataaaacatcttccttattctaagaggtacatagtgtactggaacaaacagccttgtaaatacataattagaacatgaagtagtatgttaatagaggttttcacaaagctgtggaagcttgtcttatgaagtaactaattccaagggagagaagccttatggaatagtgacattttagatagggtgtcattctaaaatacagcaaaaggcccacagtaaaaaaggaattttggttgttatgaaaattttcagattttctatgttttcagtacagtatacatggtgggctatgtgaatgtttgtatagggaccaaagtaggaagtgaggttgtctgttagagagcgctgagaaaccgaaaatagggagagatgagttggaatatgctgaggaaaagttattaggagttttcaagaaaggccacgacagtggggctagagagaagaggctaaattaaagagtcatttctggtttagaattgataaaatatagagacaagcatgataagaaagaagtcgagaagtaaacgatggtctcaagatttctagcttggaaatcattgactaaaattaaaactaaggactggattaggccattcttgcattgctataaagaaatacctgagactgggtgtttataaagtaaagaggtttaattggctgacgattctgcaggctctacaggaagcatagcaacatctgtttctggggaggcctcagggagcttttactcatggtggaaggcagagcaggtgtaggcatttcacatggcgaaagcagagagagagagttggtggtgggggtgggtggctacctacttttaaacaaccagatcttggagaactcactcattttcatgaggacagtaccaagaggatggtattaaaccgtgagaaaccaccctgatgatccagtcacctctcaccaggccccacctccaacattggggattacaatttaatatgagatttgggtggggacacagatccaaatcatatcaaagacttgcatgggaaaataaggaattgttgacataacatctttgaggttcacatcaaatgttctgatgaggatagtccaagtagcagttggctatatacctcagataagggctgaaatttggagctatgtcataatcagcctagattaagagtcaataatctcctgcccatgggccaattacacccaccacttgtttttgtaaagtagtattgaatcccagccatatccatttgcttatgctccatgtataccttttttttgaacttcaaggcagagttgagtagttgtaacaaaaaccatacggcccacaaagcctgaaatatttgttctcaagatctttatctataaagtttgccaatacctgctgtagatgttagttgaagctttgaaagcaaatgaggtttcataaggcagtgtccatacaagacatttaacaagtttacctataaaaactagaattcctttgaggggaacacatcctagtctccattaagcacagtagaagagtcccctataatgggaaagaggtcactttaggtgttgatgttggtggtacaggtcaaagaaaatttatctttgctgtttattcagaatgcaataagtgaagttatgagaaataagggaaaaaatgtgtagaatttcaacagcgaagagaggggataaaggcatgagaatgagttcctaagctcaagtattataaacactgtgagaaacttaaaatcaaagtatgactccaaacgtatttgaagcctgagaacaaggctcacaacctagggaggattagggatcaataaaatagagtgttacaaagtataatgtcaatccagagttgtaaaaatatcagcattgaatatattgaaagcagtaaaactgaatgaggagactatcattttatatcactgtgtttatttctttgccttgttctataaatatttaaaattataaaatttttattaacagtgagagcagaactaccagagtgagcagatcaaaattgggacagatgcttttcactgcacacacttttatttttctgctgttcatgcattatcttgtacagtgcacatgttttacctaaaaaattaaaatggagtctcctgcttaggaaaaaagtatatattctgtttcaaactatatacaaaaataaaatcccaggtgactaaaaactgacatgagaaaaaaacaaattgataaagcttttacagtaaaatagaggagaatatgttaattaatatagggtaagaaaaaattgcttacacaaatgatgaagcactaatcatgaataaaaataataaagtggactaccttgtatattaataacatctatacatcaaaagacagcactgagagagtaaaaatgaaacccacagagtaggataaattatttggaatacacacataatggatgaaatgtgtgtattcataattataaagaattcctacaaatctttcagaaaagaacagataatccaatagaaaaatgggaaaagttcttgaaaagtgaaccatggcacaaaaagggcttgtggcctgctggcaatattctgtatcttgacctggatggcatttttaaggtgatcactttatagtaaataactaatgtgttttatgcatcatagtaacgttaagatttttgtcatctttacaaaataagaaatccaaacggccaataaatatataaagaatttctaagtcccattaatggtccaggccatgcaaattaaaactaaaatgaaatatcactgcttaccaaccagaatcattgaaatttataagtctgacaattccatgtggtggtgagaatatacagcaattagaaatttcacacaatgttacttggtctgtgaattgtaaatagaagtgtaaaattacactactgcttcttggagtgaaatccatttggcactatttagtaaattcaaagatctgcataacctatagcccaccaatttcacttctatatatacactctacagaaatgcatatgttcatattccaggagacatgtttgggaatgtcatagcagcatagtaatagccccaaaccaaaactacttcagtatttattaatagtaaaatttgctatagtttgaatgtgtctctttccaaattcaggtgtcgataatgtgctagtactaagaggtagggtgtttaagtggtgattaggccatgagggctccttctttgttaataaaaataagacccttataaacaaggcttcacgcagcattcagtcagcttgctctcttgcccttctaccttctgccttgtgaagatacagcaggaaggccctcaccagacaccaaatgccagagcctttatcttggacttcccagcctccagaactgtgagtgaatacattggtattatttgtaaattacccagtctcaggcattttgttataacagcacaaacagactaagacaatcatacagtgagaaattaatcaacaactaataagcaaagaggtagattaatcttgaaactatgatatagagtgttccatttggctgctggaagttttatttcttggtctgggtgatggtcaccatgggtttatatgaatggttccctatattatgtttcacaacaaaaagcatttaaaaagtaaatatatgtaatgtactcagggataggcatggccaaccatggattctatgctgaaataatgattcagatttcatcagcaggctaatgacactgcctatttaaatactttaagtcctgaaattaaagaaggtaatttctcaagaaggaatttctaatttatgggtgggtctattccccaccagagagacactagcatggctcagattctatgttggtcattttatttgcatttaaagtcttaagccaaatagaggtacactaataatgacaacaactactactactcatacttgtggaacactgccagatgctgttttaagaaatttgcattttcatttgtaactgagcttacttgaatcttctctctttttttcttggttaatctaactactggtctatcaattttacttatcttttcaaagaatcaacattttgtttcattgatcttttatatttttgtttcaatttcatttagttctgctctgatctttgttatttcttttcttctggagctttgtgttggctttgttgttgattctctagttccttcaggtgtgatgttaggtagtcagactgtgaactttcaggctctttgatgtaggcatttggtgctagaaaatttcctcttagccttgcttttgctgtatcccagaggttttgaatagattttgttgtgaatgtgatgaaaacggaacatttgtacactgctggtgattgtaaattagtacaacctacatggaaaacagtatgaagatttcttaaagaactaaaagtagatctaacatttgatctggaaatctcactaccgattatgtacctagaggaagagaattcattatatcaaaaagacacttgcacgcatatgtttatagcagcacaattcacagttgcaaagatatggaaccatcctaagtgccagccgaccaatgagtggataaagaaaatgtggcatatattttcatataccgtgaaatactattcagccacataccatgcaatactactcagccgtagaaaataatgaaataatgtcttttgcagcaactttgatggagctggatgccattattctaagtgaagtaattcaggaatggaaaaccaaatactgtatgttctcacttataagtgggagctacgctgtaggtacacaaaggcagacagagtggtagaatggactttgaagactcagaaggggcagagtgggaaggtagtgagggataaaaaattacctttggggtgtaatgtacactacttgggtgacacgtgcactaaaatatctgattttacttctatacaattcattcatgtaaccaaaaatcacttgtattccaaagactattgaatttgaattttttaaaaacattaataaaataaaagatgtaaaaaaagaaatttatatatactcatttattgagctcccacaattaaccttaggaggtaagtacttcataattggtagtatacttatcttttactaaatatttgtattacttgggaagttgagggttggggagaagtagcaaggtactatgatttggggcagataactaacttatttattcgcacatacagtttggaccatgagacacgagctcaggtccctcctcctcacctaatcaaagatgaaatatgtgggatgggatgaaataatcagcagtccaatgctgagtttccagaccgaagtataaagcaacaatggatatgtcagaagtctactagggtgttatttatttaaatctatttcatggaatttactaccaccttaatggcccgaaagtgttaaagtatgccccagagtaccgaattactccctaaatgtaatttatgcttgagaataatctgactaacttgatttagaacatcagaaaataagttatgctgcacataaatgaagcagcagtgtaattttaaataccggttgcacggtgaatgagaattttaatatttgcaaaattctaaaatcacttgatttattatccttatgtttatactgacatttttttgccctttgttaagttccatccatatttcttcttactgccaagaaaaaaaactttttttcctagaaatattacagaaggcaaaaattatatttgtttccctgaatgctatttttgatgtctctacttgtttctcattgttaccatttgcttcattcatgggcagcccaattaatggagcgagacaaatttagggagcacagtgactaattagatattaaattggtaaatctaactttgtaaaaccagaaaaaatatatatatatttttttcatttggaattttccttggtggaaaagagtttaaaagtagtcatgataaaaaatgtaattttacgtagtaaattcaagaatagatttagactgtgctattaacagcacctattaaatactgaaaagtgtattttaaaattttatgtgaggcttgaaatggagtctaaagtattattactcacattaagtgtcatcacatgtaaagcccatgattttattctttaatattttgtttgaatagttacttatttcaacagtaatttcaataataaaattaaatcaactttacagttttcaaaggtttagcagttgcatgctgtaataaatacttcatatttatatatttataaagtgacagcataagtcatttttattaggtccttgaggatgcaaaagtttggattatacgaggagacgagagaaaaagggaagaagggcatttcagaaatatgctaccgatatgcaaattcacaagtcctaagacagtagcaggggtcgggcagaaagtccatcctgcctccctcttgtgggcctggaacaatggtgtaagtggaaggcctgttccccttctcttcctacctccagctctgtcttacagagctacggataccatgagcaagtgtatgaacccttacggttttcttctcttgggagaatgtaaaggaaagataacttgtagaaacttgtagataacttgtaaaaaggaaaagaattcagggtgagagggggatttgttgaatttgatagaggatggcaattaccaatatgatgagtgattgagaaacaagtctgtgcaacaggtttgaaatcgaaaatctttgaggtgtacaggatcctgaaatgaagaatgggcatttatagcagtatgtcagagaaacagtcacctcctagtagctaaaagtgttggcaaaagtatagttcaagtgattgggtaggaaaaacagcaaaccaagagtggagactgatggttgctacaaaggtggagtggtaagtcgtgaccaactggtacttctctgtgctctggttagctgctgactgtttctcagactgtggtagcaggaggagggttggagttagcagtcatttgcatatgagactgccatttaaaaaaaaattttaaattatttcatttttctgactctcaatatgaaaagcacattgtagacaaattgaaaaatatagaaaaattatataagaaaatatagtctcaccagtatggaacaatgctaactatgttgcatagatttttagattctcattcaaaagcaactctttgactccagtgatgcaaatgcatgtaacatatgcaatgtgcaattcatttttaaagggaataaacttacgatatattcataggtcatttattgtgtgttatataccattgaaaatatatgaatgctaaattattagtaaacatgcaaaaacattggcaagatcattttgttgtggaaggatatattgtatctgaataactctagaataccataaatcatcaaaggcaacattcttatttttcactaactacagttagagaatacctcttcggctaccttcggttgccttttttatgctaccaaaatgctgtctgttttacaagattttaaaggttaagcatataattattcattaaatacaatgagtgcaatgtacatgtagatacattattaaattttgggtagttaataaaaataaggggaaaaaacctctagaactatcacttttaattgtttaactgataaagtgaagcttcatcttggaaaaataatttcacaagagagcatgtgcactggtagaaaagtgccattgaaacaagagatatttgggttagaagcctctctctactatttaataccattttcaccttttggcaaattacttggcctctgttttctccaatggaaaatgggaataataattgttatgctgcagggttattgtaggtgtcaatgaaatgatgtgtctggcactataaaagcacagagcccggtgcctggctattagtaactgtttaataaatgttaattcctttctctgcccaggacatcagtaggcagatgtagcaatttaaaacttctagtgttactttaaattcctgaatgaaggtagaggactgaaaagatatcatggtattcaaaagtatgatccattgcttcttaagaatagagttcagaaaagcttgacagattcctgtactctgaggcagcaccatagccggtaatctgtaggatggctattggttttgtgctcacaaatgcttgcttgggcaggccccaggaaatctggtagactgtaagcccagtaagatttcaaatcttactttacggcagtgtttttcaccttgactgtacattgaaatcacctggatgctttgaaaaataacagcgtcagtgtccaacctccagaaatactgattaagttggtctggaatggagccccaggatcactgtttggttattgttgttgctgtgttttaaatgccccagttgattcttatgtgcaactgtcttaggtaaacatacagccctggttcatattatttctgcctcagtctcttttatgactggaaggtgaccaaatgcttgtttcctaatattctttccatgtgtagtattaacacatttgacttgtactaagttcctgcagtattccaatctaaaattttagtgactacaataaaataagaaggattaaagaaggcatcgcatagtttagtatatcggttatttaatgcttacatgtgagcctacaatatgaattatatctgtcatcttattttaaatattgacagaatctttaatgatagtgacgaattattgatttattggtgtgataatggtattttagttatatttttaaagttttatttgtaataactatatgtatttatggggtacagtgtgacgtttcagtgtaatgtttcattgtgtaatgatcaaatcaggtttcttggcagatccatagcctcaaacatttataatttctctgtggtgagaaaatttaaaattctctttcactattttgaaatatacagcacaatattggtaactttgttcatattactatgcaatagaacactagaacttattactcctttcagttgatgaacaggcagttttggatcaagaataatattgaaagtgatagaatttatgaagtaatttttatccaaaaatattttgaaagggaatatattgcttccaaataatttattacaatgttaagatatttgtaaatttctagaattaaaaaaatatatttttaggaaagaaaatgccaatagtccaaaatagttgctttatctttcttttaatcaataaatatattcattttaaagggaaaaattgcaaccttccatttaaaatcagcttttatattgagtatttttttaaaatgttgtgtgtacatgctaggtgtgtatattaatttttatttgttacttgaaactaaactctgcaaatgcaggaaactatcagagtgatatctttgtcagtataaccaaaaaatatacgctatatctctataatctgttttacataatccatctatttttcttgatccatatgcttttacctgcaggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggtaagtctttgatttgttttttcgaaattgtatttatcttcagcacatctggactctttaacttcttaaagatcaggttctgaagggtgatggaaattacttttgactgttgttgtcatcattatattactagaaagaaaattatcataatgataatattagagcacggtgctatggactttttgtgtcaggatgagagagtttgcctggacggagctggtttatctgataaactgcaaaatataattgaatctgtgacagagggaagcatcgtaacagcaaggtgttttgtggctttggggcagtgtgtatttcggctttatgttggaacctttccagaaggagaacttgtggcatacttagctaaaatgaagttgctagaaatatccatcatgataaaattacagttctgttttcctaaagacaattttgtagtgctgtagcaatatttctatatattctattgacaaaatgccttctgaaatagtccagaggccaaaacaatgcagagttaattgttggtacttattgacattttatggtttatgttaatagggaaacagcatatggatgataaccagtgtgtagtttaatttcaacttgtggtgtcctttgaatatgcaggtaaagatagattagattgtccaggatataatttggttgctaaattacatagtttaggcataagaaacactgtgtttattacacgaagacttaattatttttgcatcttttttagctcaaattgttcatgttgcaatagtcaatcaagtggatttgaattgtagccaatttttaatgccagaaaatactgattaagacagatgagggcaaaaaacacccagtagtttattaaatactttagatatttcaaaatgctggattcacaaaagcagtatcacatttgactttacaagtcttcattctcaaatatgtttccatagtaaatatgccctttaatattaaggagttaagcatttaaacacctatttatatgataagctatttaaacacagaaaatatttttaaaaccttgtgtaattatatgtgtatcaatcaaacttgcatgcacaccagcgttggcatttgtatagagaggaaatgtatggattcccaatctgctttaatatagaagatacattttaaaaatagcactgaagtgaattttgggctaatgtagcataatggggtttctgcctgagaggcagaaacatattagagttatataaaatgttttggggtagatatagaaaccacttgccattttcaatgatatccaacccaaggtagttatatatttcaatttatattttattatcaaattagtacttattgtgaaaaaaatcaagtaacatagaaatttgtaaaagtacctccattctactctttggaggatagttgttcagtatgaattttgctacatatttcaggctgggtttcttggaaagccattgtaaaatggagatttgtatgtagaaggttaactagggagtacttttacgatgaagcaatttgttttgatgtaacttggtgtagttttcttcatgtttcttgttcttgaagtcagttaagctcttgaatctgtgcatttaacatttcatcaaatttagaaacctttcaaccatttttttaaaaaaaatggaactccaattgtacatttattaggctccttaaagtgccccactactcactgatgttatgttcattgtctgtttggtctctcttttctctgtaatttgttttatataatctctattgtcaaattgactaatctttttcaaagtctaatctatggctaatcccatgtagtatatatttttaacatcagacattttcatctcttagaagtaaaagttgggtctttttatttcttccatgtgtctactcaacatgttcagtctttactttcttgactatatggaatacagatataataactgttagaatattcttctctactaattttatcatctgtgtctattctgggttaatttaaattgatttatttttctcctcattaagtgtgttgtttaactgcttctttggatgactggtaatttttgactatatgccagacattgtgaattttaacttagcgcgtgcttgatacttcaaataaattcaaatatattgaaataaatattctcaaacctcgttctggaacacagttaattcacttggaaacaatttgatcttttgagaatcttccttttatgctttgttatgaccagaacagtgtaagtttagggctactttttccccactactgaggcaaaacccttctgagtactctctctgatgtcctgtgaatgataaaatttttcactggggctcgtgggaacaggtggtattactagccacgtgtgagctctggtgattgtttcctttaattcttttgtgaagttctttccttagctttgagtggttttcttgcatacatgaactgatcaagactcagatgaagaataaaataaagctttctacaaatctccaaaatttcctctgtgtatatatcacctctctggtattttgccctgtgatcactagtcagccttgggctgctgaaactctcagcttcatcttttaacaaaagcctcctggcaaggatcactgtccttcaatgtctgatgttcaatgtgttgaaaaccgttgtagcatatattttgtctttttttttttttttttttttttaagtgtttcaggtgtttcaggcaggagattaagttcagcctcctttactccaacttgaaaacaagtccaaaacaaactattttgatgtaatttgatcttttaatacattaacattacacaattttgtgaatatatcataatttaaaattttcagagaatgtctaatggtcctcatttcttgacagtgtggtttagttgaaactgatgaacattttatcaaaacttttcccctcaattggatacttttttttttttgagatggaattttgcttttgtcacccaggctggagtggcatgatctcagctcactgcaacctctgcctccaggcttcaagcaattctcctgccttagcctcccgagtagctgggattacaggtgcccacccccacacctggctaatttttgtatttttagtagagacgagatttcaccatgttggtcaggctggtctagatctccgacctcaggtggtctgcctgtctcagcctcccaaagtgctgggattgcagacgtgagccaccatgcctggccaactggataattttaaaaagaccattttatttagtctattttttctcaatctatagatgagataagaaaaatcattctagatgtccaaggaaaaattctttcagaaaagagctgtgaatgatatcacaaaccccccaaacagttaaggtatttctttcctggttattttatgtccaaaatcatgcatatgaacatgtgcacacacatgagcgtgcacacacacatgaatacatatacacgcacataatgtaccttaggttatctttccattctgagtaattatcgtaaaatgggtaaaatcaaccccgtaagataccttcatcgataaggcaaatcaaagctttggtaatttctgctatcttggcctttgttgattgactaataatgaataagagaatgagtttcaatatttactatgaaattattttagaagacaggatgtagacagtggctgttagcaggcaattgtttggcatgagccagtaatggttactgtgaaaaaaatcaaccaagcagcccatatattaaacaaacacacgcagaagcacgttggagtctgaagcctcatatgtacaattttcagtaaagaaataacttttagatatgaaataaacaaatagatatatgttgtaaacttgtccctatgtattttgatcaaattgcatcatatttttttcactttaaagaagagaatttagtgctttaactgagacttagtgttatcattcaaaatatactgactgccaatagcagtagaaagataatctggttccatgcaactctattttttttcctctgtcgcaagtaaaagacaaaattaagtacatgaattagtgctttttgaagatattccagagcaatataccatgccactatggagaacctctctaaaaatatcccatttttttacctgagaaaaatattgatcatgttatatgccactcaaattggtttattaaattcgttgaatgatatcagcatctcttaatgcattcactaaacaagcagtaattgagtgcatatacaaagttttatcatccaccaaaacagtgacaatccacatgaggctctaatagaagtttagaaagggggttaagtggttaaatgctggactcagaaagattggattcaaatcccaggtcctttagcttaatagttgtagaatcttgtgaaaatatcttaattcttttcatgtctctgatttctcttctctaaaatggaaatataaatgagatgtgtataaagccacttggaatagcattttgcacaaaataattactcattaaatgtaagcccctattataactaatcactctttataagtgattagttcatatcaatacaaactaagacttatttactgaattatcgtctctaaacatccacactgcagaaaaaccaacctggaaatttcataaaaccttatttttatgtagtataatttcttctcaaagcataagggctcttggattaggaattgaggaaaattccaattcagccaaacgcatctgtttcagatagctgacacttctgcctactcatttcctagctaacaagaagaaatgttaatgggagttttcaaaggaaaagctgaacaccatgaaggaaagtgacacaaataatgttagctcatatattgacagggtgaatttgtgtgctttcaagtcccttcagtgaaaataggaaagtagaaattataaaatgccctaacatttaaagctagcatgttcttggagactaggaaaaaataagttttaaaacatgggctatgatagaatgagatggaaaatgtttgtagttgccagtagaaacaataacaattaccattagattaagtatttaaaccagctgaatatttttattaatggaaatggcatctgttttatgaaataatgctgctgaatgaaccatattaaaaatgaccagtatttcctgcagaacgttgtcgcagacatacaagcctgagaccctaaaatcttaaggtattccatttgaaatcgaccttaagacattaacagtagtggtattgtttagatgaaattttttaggctttaaatcaacaaatgttaagcagacatggggagcgaaacaccagtgtgttattctgacatgaataaactgctgtttttagggaaaaaatatagtcttgttaaggttaagctaattggttttctggtatcttttgcaatgttagtgtgttttactgctccataacctatgttatatggtaaatgtgcaatatatttatatatgttgctgtaaagaaatgtaataaaaaactgtttactttgtgatatgaaagtaaaaatttattcattgtcattgagcatacagaagtaaatatggattacatatgtcatattttaatgttcacatggtcccaccatcaaatgttgaaaaacttatagtttaacgtcatattctattgaagaaaaatacactcccttttctcaaatgtgaaatgtccagagagaatggaaaattacatataaagcatgtagttatagcatggtgaccctgctgtgatctctcagatgaggaacaaaagggagaaagaaagagcacactggtgctttggagttgagagaaggcaaaaaaagagtacaaaaatgtcaaagccaagtttagctgctcttcagctctccctttagctgctcttcagctttaccttaccatggttattagtgattgaagaaaattctaaagcactttttaaaggacccaattctgaagagtttagattcagagagcacaatggagttggagtgactcctgctcaaaagtttgagacaagcgagtccatgaaaagaccgtcctcctcttaatggaaatacccaggttttctcattcttctcgccttgctttcagcactcgcagcccagaaagcccttatctaacaggtactgccgttgaaaggtcattgacttgtacaaaaatgatgagtgctgaatagatgtgcataggtcactgacagtatctgctacagagaatgagttttcgtatttttattaggatacacctaacatggcaatctactgcctcaaagaactctataggaggtaagtgaatttatattaatacagattgaattaaaggataatctagaaaaaggcatatgatgtaaaaaaatcagacacaagtatattttctgtatagtcagtttttacattgtgatttcaccagctggctgctgagtttgacggcttcttaacagccacactgctgagattcaaatgctgatagaaactttgatggaaaaatcactggagtaaatatttctaccatctgttgcccttcactgggaccctaacgttaagaataattcataccattgcttgtcctttatatttccccagcagtaataaaatttcataagattttgttttgtggtcacaaagctatcctggtttctgtaactagaagacatacactagcataagggaatcagccggaaaatttactgctaagagaatttgtctctagtcacttactttaaggttacagcaatgtgtaagtgtgggaatacattttaaaatgagcttttcaaagttattagctggtagtggcatgagagttaagtctcttaatacagttaaacagttgggcacttcatccttgcgtaaatattgttacccttttattgctgcttggaaactcctctgcaactttttggcccctatccatcttttcagaagtagtaaataaccaatttactgggagtgtggtaccaggcagaaattccgagaggggctttcaatccttgcccatcaagtgtatctttcagaaataagtatattaaaataattggataatttcagtggcttgttattagacttccgttgtccagcatggcatgtttaagaagatgacagattttcatacattattggaaagaagcaagaacaaaaaaacataacttactgtagtaaccacggtaaagaactgcttaaaatgcaggataaacatgtcatccctaagggattcccattcttagagcatgaaattatcaagagagtaagagactacaaaaaatgagaagaatgctgattgcaaattccaaatagaaaaaatcaaaacaaaactgcgcaccatcattctggaagcaatgagaagcagaaattgtcatttaatgaaatgtaagattaaagttaatagaagtaattttcatgaaataatattttgcaaggacgatgttccagccatattgatcttcgtgttttcttttcacatcccttcttactgttccctagaatgcttgtttctacctttaaatttgcttttctctctaccagagggctctaccctatctccagtttctcaccatgtcccaatctactccctctcagaatttttgtacacttccctttatatatatttgtgctctaattttatattcacagatatgccttttgtaactcccccatcttaaagaaagcacacacgtacgcacacatgcacacacacaaaattgaactctttctgggagatctgcttaactttcttcataactctgtcacttgctgaaactgtagtatgtgttttcatgtttattatcttttccattagaatgaacatattttgggtacttggtctttctcgatcaccaatatacctcggtacgtagaaaaattgattcatatattgaaaatgtaatattcagtagaacgaataaatacataaataaatttaaaaatgatacttttattgtattacctgagacaaatgatccccaagtttgtccttgcttttcatagccaaaacattctctcttacattgagcttccttcacctcttctgtgtacagagcacttaaaattttcacattgcctgatactttaacaatatgatggccctgttctcttacccattggagcatatgttaaataccagaacccatgtaacaaacatatattgtgatcctactgtgtgcaaagcagatactgcttgctgctaggaatacagagctgactaagagctccttttctctttatgagctcacagtctcatgagttcaacgtcttaaggcacaacgtctaaagcaaagggcagtaagtaaacactccagaaagtactggatctggcctaggacaaatggtgggttgtttttccagctgttatttttcctgccccctaattgacagtcctccattacacctctgggatacctagtctgacttgggaaaacctgactttgggaatcagaggcagtctctcttgcttatatatgaggaactctaatggatacttactgtcattagagaaactctgcttctagcctggctccttttgtaaagaaggttgagtccccttggagagcctgcagaacataaccatttgcatgtaatgaacagtttgtaatactttgagattgatgtgcaatttctatttgacaagggaaaaacaattaggattaaccgtggtcgtatatcccagaataccaacgttgtttccacactctaagtgttgttgggtcattatatgagattcataattttgtcctgttgtacccacgtttgcattaccattcagtcttaatttattataccctattaaaagtttttttggtaatttgttcttattgctactcaggcattaaaatgtctgcaggctgtgaaaatgaataaatttaatgtggcagcatagttctcaaaatcctggctttacaactcatagtacaggcttgtattgtaaatcctagttaacatggatttatttgaaaatccaattttactgctaatcttaaataacacatttttcaaacattttatccttgaatttctatttttttataatttatggctgttgtatgtatttacaaaaggacaatgtgtgtacttttaaatactagtaatggattgctgaaacaactgtaactttaaaacaatgcaattgttaaaaaaataaactgtgcagcctggcttaatggaggcttatgaacatatgattaagatatatgctataataagcaaattcactcaactgatagttcataggaactttcaaatttaatctcataaccagtgctatccttcaaagaatggtcagggcaatttaacgagtacatgaccacgcaagataatttcattgaagagtggctgaactgttgaaatattttctagtctccttgggatatcattaagagcagaaattttgaaatggaattgtaatgatgttcagaaaagataagtaggtaactctcttaatacgttttgtgctgctgtaacaaagtacctaagactaggtaataatttgtaatgaacaaaaatgtattggctcacagttctggagactaggaagtctaacattaaggtgtcagcctctggcgagggcctacttgatatgtcatcacatgatggacgattagagggcaagaaagatcaaaagggggctgaactcccacttttataagggaaccaaacccactcgtgagggtggagccctcaatccttaatcacctcctaaagctcccaccccttaatactgtcacaatggcaattaaatttcaacatcagttttggagggaaaaacattgaaaccatagtagtgatactgactactaccacacagggcttgggaggctaccctagctgttgcacccaagagatgaatcttctaatgtgattacctttatcattttttttactttattaaaatacttttattttacatgtatacttttgtctacccaccatttccatgtctgaccactgctactactatgtcctagcataacattccatacatccttaaaaccaagcaaagggtggagttccatctttaaaaactaaacaggcattttggacaacacattcttggcaatggaatctggacaacatttatcaaacatggtagggaaggttctcactctgcattatcaaaacgacagccagatatcaactgttacagaaacgaaatcagatggaaaatttttaacaaattgtttaaactattttcttagagagacttcctccactgccagagatcttgaatagcctctggtcagtcatctggaagcaattcttcacataattcatgaacttggcttccactttaggaagagaaccacctttttctatacttgcttgcatttttgctttaatgtcttctacagaactaggtcctttgggtgttttaggagtttttccttgttttgaaggattcttgtccttttgatcttggtgttgacggttttgagtcttttccattccgatttgacttttgtgcatttttggctggagtatctcatatagatttcttcactggcgctttttcttcagtttcctcatcatcaaaatcatcatcatcatcaaaatcatcatcttcatcagcagcaagttttacttttttctgtggaaccttgctaccacctccaggagcagatcgctttccagatatacttatgagtttcacatcctcctcctgttcgtcttctgactctgtatcttcctccccagctactaaatgctgtccactcacatgcactggccctgaaccacacttcaaccgtaagaccactgatggtgttatttcaaagccctcaagggaaaccatgggctgtacagacattttcaaagctgccagtgttactttaattggactgcctttgtaactcattgcctctgcttcaacaatgtgcaatttatcctttgccccagcccctaaactgaccgttcttaaagataactgttgctcaatttcattattatccaccttaaagtgatcatctttgtcggcctttagttcacaaccaaaaagatagttttggggcctcagaggactcatgtccatcatcgtccatcaggtggcaggacgcacttaggtgggagagaaggcagatgatgataaaggaccactgctcaagagaacagctgtgcaggacagaatcacaccagggagattacctttatcttagaaaacctgaacatcttgtgtactttgacacttctctacatttcacctaacctttaacatcaacacatttattcagaaaacttttacttttggagctgctctgtgtcaggctctatgctaggtgctcaggatattgaaattgatacaatcctaacctattcacatataatccaaggtttgctgaaattgatggacatttaaacaattgaaacatttaagtggtataattagcaaatggacatttaagccataaaaatagcatctaatagatataatagaggtcggtacaccattgatgagtcagagcagaggcaacccaaagagtaactagccagaagaattgggaaagcttcatagagagagcgatatgaaaataagggagagaattgtaaatccatgaaaatgagaaaaagttgaaaagtgatggtgtcagaaaaacttgtggtatgataatgacaagatgagaggaactcttggtaagcgtgttggatgcatggaaagaaatggcacaaaataatgctgaggacattttttattttattgttggttttgttttggttaatttcattttttaaatctagtatgctagtgttcattgtccaaactgtgaatcataaactcagtttgtggatcaacaccggcctttgatttttagtgaaacaaaatagaaaatatcagcattcatcacaaatagatgtttcacagattttttgttttaattgcgactgtgtgtgtgtgggtgtgtgtgtgtgtgtgtgtgtgtgtgtgtgtatgtgagagagagagagagagagagagagagagatggcttggatgtttatcacctccgaatcttatattgaaatgtgatttccaatgttggaggcagggcctggtaggtgtgattggatcatgtgggtggatccttcatgaatgatccctttggtgacaagttagttcatgctatatgtggttgtttaaaagagtatgagacctcaacccccacctgtttcctgctctcccctttgccttccaccatggttggttgtaaacttcctgaggctctcaccagaagtagatgccagtgacatgcttcctgtacagcctgcagaaccgtaagtcaaaagaaaaccccttttctttttaaagcacccagtttcaggtatttctttatagcaatgcaagaagggactaacacagttgtatgtgtatgtgtgtgttgggtgatttctggttgagtgtcacaaggttgtaatatggtgagtgtaaggaagtataagttttagaaaattaagaagccagttcagaaaactaatacttttggaaaatagtacaaaatcaactttacaagaatatacacagaaagatgtaatacaagatttatttcattgcagtaatttataaagttggtttagtgccttgcttttgcatgctgttttaaaaattaccaagaatatgacttcatgtgattttgaaatactcccagcaagataggtagaaaaggtattcttataactcttagacaaaaatttcggaaagtttaaacgctttatcccaaatcataaagctaataaatgaagaatctgggattcaaacaccatattttttttactgttcatcagctagaagttagaaatgttaagccaaaaacattaagtcactgctctgcctaataaatcttgaggaaactaataaaaagaataataccactgactacaggacaaggtcttcctaagagaccttaaatatattaagtgatgaagatgaaacttcttttattcataaaaatgttatttagttatgagtagagctctaattaaacttattttatattgtcatcagtaaagttgagacataacatatttattaatataattataatttgacccatagtgtattaaaagaaggatgttaaaaggagttgttattagagatgatgttagggttgttgatgataataacagtagtcataacataacaaagcacttcataatttaagaagtgccttcaattacattgttactctcatggtaatctctgtttgatatatagatttggcggattctatatcactctaagacataggttactgaggtgacggaggaatttagcaagcggctgtcaaatggaggacatgagcattggattgtgtatggcaagggctgatggtctctaagaaagcctcttggtttccacagggcagaagccctttgaagatcatagccaaggatttagtaattgcctccctttcagaataccctcaagagaaaagcccaccataagacatggttccctacaggcaaaactgcttttccttaaaatttactgttccctgaatatcagccttctttggctcattcaacatagttttcttaagtttcaggacagtgctgcagaccaaaagtttcaacattgaggaaaacaatactacttgtgcagtgaccctacctcagtcagggaggcagatgcctgcctttatgtgagggaataaggaatcaatcatatttccagcactcaagaaagccagtctagtgcagggagagatagatacataaacctcaaagttatgatatagcataatagttttaaatttccataataactgtattttaaaagttttatagaaacagaagagatgacctcagtctggaaaagccagcttggagaatggcaaccaatattaagtggcaaaagctttgggatcccaggcctccagatggagggtgatagcatgggccagacaggtaggttaggaaaactttgcaaaggacattacacggtacacagacaagtctgtgttttagcctataaaccacagttgcagaatgtgtttgagcaaaggcttttggggatgagatttgcacttttcaagatttaagtttgtttaggatacttacggtttgctgtatacttcctgggtttttacattataattacggtttgaactttaaaggaaaactgcagtttagcatacttgaaagagtgcaacttcaagtcatgattggagacagatatttaacagattttgtgatcctgtgatgcttattttcttctcagacataccacatgacaatcatttttaaacagtttatttctactttagcatccatctgaaggtgttgtgtatgttttctgcttgaaaataaagcagtgggctgggtgcggtggctcacgcctgtaatcccagcactttgggaggccgaggcaggcagatcactaggtcaagaaatcgagaccatcctggccaacatggcgaaaccccatctctactaaaaatatgaaaattagccaggcgtggtggtgcatgcctagagtcccagctacttgggaggctgaggcaggagtatcgcttgaacccgagaggcggaggtcgcagtgagccaagatcgtgccactgcactccagcctggcgacagagtgagactctgtctcaaaagaaataaaaaagaaaataaagcagtgaatgcgattaagatggatttattatgatcataaagtactcaggagtcttattttaaaagacagcattactgtaattaaaaatatagggaagaaactaatgctgttttgcgtatcattctcagctctctcaaaatcagatattaagctcttgctgccaaaggagactatactgcacggtgctcacctgcataaactttgagagggttgaattgtgccaagcaattctctcaatacataaattaaccaaatatttgttgacctactgtgtgacaagtattattccaggaaataagagatccagcaatgaaacaagtatggcttcttatagagttcccaaaaaggaaataaaaggatatacgtatagtgatatccctgaattaaatttctcttttgaaaataaaaattctatcataagctgtaactgccaacacttcaatactcattcagcagttttcagggatttgtaccttttgacttatgagaatttggaagtctaattgtatcattgcactggagtcttaaagaaacagataagcgaatgactttgcctgtatcattgttgactgtacttacaatcagaaaggggcacaggacagatgccagggagtaagtggacagcccataaatggaatggtaagaaagaagaactatagtggatttggaaagttcccttcagcattttccctagacaatctttggctgtgtttgcatgatcagtatttcattcacaggatattgagctcttgatatagttctcaaaacccaaaatgaaataagaagtctactctttatttaaattcaaattccagagagttaagtaactttccaggaggtaatctaaatatggcctccttgttggggggggggggggtgtttgaatttgcatataaatagtctcacccttaaaggaaaaccacagatggtggtaatgatgtagtcataatgtacatctccacagtggtggaacaaaatatccacagttttgctttccccagtttcagtgacccatggtcaactgctgtctgaaaataggtgactacaatacaataagatattttaagagagagaaagaaagatcacattcacatgattttcattacaatgtattgttataattgttctatttttattcatgatttttaatctcttaactgcgccaaatttataaattaaaatttatcacaagtacatatagtttatatagggctcagtactatctgcagtttcagacatccactgggagtcttggaatgtatcccctacagataaggggtaaaccactgtatcctatttgtgtgaatgctacaggtgttgtgagctcataacaatatgacatcaacactgaactaatccaggatttggtagtgagagtgatgtatttgcaaggagtgagacgtggtgcctcatccaagcagagaaataattttgaaatttgcctgacaataaaaatcacaatgtgaggtctctctttagagctgcaaagtccaattcagtgccccctagccacataagatactgagctcttaaaatgcggctagtactaattgagatgggcactgagtataacacacatgccagggtttgaatacttagaaccaaaaaggaagtaaatgctcatttattgcatgttaaaattatggttttattatagttgattaaataaaatatataattaaattgacttcattttgcttttaaaaatgtggctatgaaaaatttcaaattatatatgtgtgtgattacatatgtgtgttttcacatatgtaactgatgttacatgtgaaattgattgttacatgtgacatgtaaaacacgttacctaacacgtgcatatgtatgcaacacatatgtaacgtgttacatatataacacgttacatatgtattgttacatgtgtgcttgcattacacacatgcataatatgaaattacatgtaatttcaaattacatgtgtatattttgaaaattacaaattacgtattttgttatttttgctttacaaagtcaaatttaccctatttaataaagcatcatgagttttttataactagtaaactttgagacttttgtaggagaataaataatgcttattataaaaactgattggaaaagtgagctggagcagggagcggaggaaaaaggactagagatcacctttcttcccagctccgctcctctcccaaccttttttctttccattctctcatcccaattcaaaagtgcagagttcacagttggtgtgctgatttagaaaacagatatataaacagccttaaattttctccaggcttttacaatgaaaagaagttcaatatcaaaagtaacaatataatctgtggaaaggtatagggggctatgtttttgaggtagaaactataggtgctcctggccaagcatggtggttcaagcctgtaatcccagcactttgggaagctggggcgagagtattgcttgagcccagaagtttgagtctagcctggcctacagggtgaaactccacctctactaaaaatacacacacacacacacacacacacacacacacacacacacacacacaaaagccttgcgtggtggcgcttgctgatagtcccagctactcaggaggctgaggcgggaagattgcttgaacctgggagacagaggttgcagtgagctgagatagcaccactgcactccgacctgggtgacagagtaagactgtctcaaaaaaaaaagaaaagaaagaaagtataggcactccttatatgcagctgctcacacccctcctccttcacacccctcccccttcacacccctcccccttccccaaaatttgcaaggggaaaaatgtgtgtaattggcagtatttagtggcgtgcaaccgtgagtcatcagactgcacatcctcacttctgctagtggctcagtacccaacagcactcagtgaaaactaactcatttcaaaggtgaaaacaagtgagtttggccaccagggagtgttcaaaactgtcagtgctgaagcaaatgtggagggtgttctgtagtttgttcaggttgatatttgtggtccaacccctagctgaactactaattattaatatctgtcttgatggtgcctcaggagaaagcttctcaaagggaatcaatgttcaaattatagtaggtatcttggccatggaagttattgaattttagccaatacttgctactctttcatttatagtgtgagaatgcagtgtaatgaacctgactctcactgtcctgacttgcctttctcatcgcattcacaataagcacgtcaatacgtatacacatttcatatttctaaagtttactttatttccttattgtacatcgctgtgctgctgatggaagagaaaaggaaaaacactattgattgcaaaactgttttatctttggtggcttagattttttttgtatgatatgtaacgtcttgcatacctaaggcaacacgaagctaaatagatttgcatatagcatgtattttttccaattaaatgtttaattttgttcagagtatactggggacattttgaataatggagaaaagtacaaagaaaattcataattctaccacctatcagcacagtgaaattttatgaagaaacataattttcatgtaaatcatagtgaactcacggtaggttttatttaatacagtaattggagagctggtaggaagacaaaactggttcaaaagagaatacaagaaacaaatgcttctataatgagtgaatttttaaaaaagtattctggaataagattagtgaataagatactaaactcgttgataccctacagcctttggggttatatcctctactgggtaaaaagtcatttacatcatatcagttttctaaaatttgcattgaacttcatagcgttgtaacatgtgtgggcccaaattaatagtaaacagtaagagttgctttactctgaaaatattgaagctcttgtgagggtgtgaggagtttgttagaaaacaacgctaccattattttgaaacacacacgatcatcttttgttttacttctaagttttggataatttttcttaaattatcttattatcttatccattttcttaatttccttaaccttttaaatgtttctcctaggcacttttattgatttttggaatatagttgatatgtgctgaatttttatcatccagttttaattctactgaaaaatctaaaagatgttcatcaactactatatttcaaatgcatacatcccctttcatgctaaagaaactgtatgggaaacacagtctgacattttcaggacctggtatcattaaaagtcttgacactgttaaaattaaacaacgccttttttaaaatcaaaggatacaaaagggctgtgttggtcagaggatacaaaatttcagttagataggagacataagttcatgagatcttttgtacgacatagtgactataattaataataatatgttttcgaaaattactaagagagtcgattttaagtgttctcaccgcaaaaaaatagtatgtgaggtaatgcatatgttaattagctcattttagctagtccacatttttcaatacaatgtgttgtataatacgtgatatatacaacttatattttccaattccaataagtaaaaataaatgtaaattatttgaaataaataaaatgtgaagaacatccacttttcatatgaaaccatgagatattttctgttaaaagattaaatgtccaataaatttttgatgttaacagaaacaaaaatgtttaatatttaaatacatatttgcatgctattgaccccctgaagttcactgctgggctaagtgaaccaactatatcttaagtcaaaaatgctgaaattcttccccaaatcccaaagctcatgaaaacataaacagaaaatttccaaataattctacagggaaaataagacacactatttgatctgatcaaacaacgggatgattatggttaataatgagttacttgtacatttaaaaataactaaaggagtgtgattggattgtttgtaacacaaaggagaaatgcttgaagggatggataccccgttctccatgatgtgattattacccattgcctgcctgtgtcaaaacatctcatgtaccctacaaatatatactcctacgatgtacccacaaaaattaaaataaaaaagagagggacccgaagataagctaatatttaagctcatcatacttattaagataagcaatacataccgaaagtaatagcatttaaaaccagatgttgggggagggttctaacttgttcattaaaattcaaagtcacctgtcttgttttttcttttgtttttgtttttttttttttttttttgagatggagtctcgctctgtcaccccaggctggagtacagtggcgcgatcttggctcactgcaagctctgcctcccgggtttacgccattctcctgcctcagcctcccgagtagctggtactacaggcgctggctaccacgccccgctaatttttttgtatttttagtagagacggggtttcaccgtgttagccaggatggtctcgatctcctgacctcgtgatctgcccaccttggcctcccaaagtgctgggattacaggcgtgagccaccgtgccaggccacctgtcttgttttatcatgatcccgagagtatatatgtatgtgtacagctcatctaaaccctttttctttcaacatgatcaatagattgaacattggagatattttataagaaataatgaagacaactcaatcagcacatatatatattaaatgtggaatctataatgattgcgaagcctgaagcaaactaaatattcagtaataggttctttttttccatggtatatccatttgaatatataacataaatgccttacatttgttttaactatttaaggtttatgttgttagtgtgatgaaatggctggcaaaagtcagaaactcaggaaagtttcaggcttatatctggagcctggttttctttcttcaaggtagaacctctgtgaagtgaaaaattttttttatatctggagcaataatgtagaagcttaaatgtattatccaagttgtcataagcctattatttctttacattactgaagtgaaagacagcattaatggctaaatgccatacttggctataatttatattgtttaggactggaaatgagcctgaaatgtacatttttttccaaaatagttcatgtaatatttgaaacctgacaagtaacctgatgatttcatggaataccatcaaatataaatgtgaagttttaaagacacagggaaatactcagaataaaccccctaaccacaggccagcagaagaactagacttgagaaaatgaatgggaagatagatagtaacaaatgacttctttggcagccttatatatgcttagtcttatagactgttttatggatgctctgcactctatttccagcaagtatggcatttggaacaggaccacacgagacaaactatgagttcacatttcccacaactgcacagatagaaagagggaacaacagaatactccctttcttcttgaaacaataacttctgttgaagctcactggcttcttttcagctgtttctgctagctcctcctccgcctcttgacctctaaggcaatgctcttcaaaatttcaagactgctttctaattgaaacaaaacttataagcacatttcttcccacaaaatgtacatttatttgtaaatcatatatgaatatgactaagcatgtaaacgtatgtgaaaatagaaatcaataaatataaatgcaaacacaaatagaagcattcacagttttcttttgtgtcccagtgagttgttccaaattcctcggaggtaggtatgtcacagtttgagactataccttcaatcctagggtttctggtttcgctctcctcctaggtgatagcatccatttctacggacttaactgccatctttagttgaataactcctctatctttccatcccatatttctcttgattccaaacctgcttgttcacctgagcatatgacacaattcattggctgccgcacatgcagctttgacattttatttaaaatctttccccttccccagccctcatctatttcacagtagtatcttcttcttatctacttgattggtaagcagagtccacatgattccatcatttatctcccattttatatctaatctataagcaagtaatgcaatgcaacttctgtctccaaaaatttattttgaatttgccttctcttcctctgcatctcccccatcttaggccaggtcacctctgccctcttgccagattaggtcacattctcttactactgttgttattctcttcctattcaatcctacaccgcagcaaaatggatcttctcaaaatgtcagctagataaaggcatttctgtgcttaaggccctcatggatttatcttattaggatgaacacccaactctttattatggcttagaatacaatgaattacaacacataatgaatatattatatttctatctttaccattttcttcttaagtcaacctttctcaatccatataggataatcatattagtgcttcctcactttctaaaacatctcagggcctttgcacgtgtttctctgttcttagacccagaatgctcttccttttctctttgtgtagctaggtgcttctttccatttacgtatcacatgaaatgcagtcattccctcctccttccctcactacctcacaaaaagttgatgcctctgttaaaccatgaatggaattttactcggcagtgaatagaggaaaaaccaatggtaaaagcaaccatatgaatgaatgaatgtcaaaaatattatgctgagccaaaagtcatagacacaaatatgggtatttacatgaagttaaagcacagcaaaactcaattacggtaatagaattaagaaagtggttacctctgggtgagggttggaattgagtggacagaggcattagtgactttttcggggtaatggaaatgttgtctattttgttcaggtggtgaatacatagatacattcaattgtcaaaacacatccatccaaacacttagacttttgcactttattatatgcaaattatgcctcaactgaaaaaagtttgttttcaaaattatatcaacagttgaaattcttttaaagatttgattcaaatgagattaattctgtatccatcattgatgtatgatagttttgtatgtagttaaggttattggagataattgaaagttatactcacaagaaggctgcataatatgaagtttatctgccttgatctttaatagctttcgcgatttcaacttcttcacagctctgtaagaaggcagtgtggcatgttgaagcaagcatgtgttttagagtaacacagagctggtatacaaccccatgtctaccaattatcaatgatgtgggtatgttgctggatctcaataatcttccactgtgaaatggaatgtaacacctgactcacaacgcaaaggtatttaccttatgtaatataattcctgcgatcctgggacctcccttaatcccatccacagatgccaggttaaagaccccatcacagactagaacaagttgggatgtcaaaatgaataaatattaatcgaagggcctattgtgattgaacaccacgcagtaggcactctctaatacctaccgtctccctcctttttgggggaaacattctaaatgtgcaaaaaataaagggttatttgctttctggcacttgggatcgatttattgaggatatgttagcagaacagcaaaggtgaaacactaaaagcaccatcaatacacaggcagaggtgaagccataaagcctttattttttaaattaatgcacaatatataagaggtatgttagaatgaacgtccaatccctgaaaggatatacgaaagacattcataaaattacatgggcatgttttcttaatgttcaaaatattgttttaattagtgtattatgagtttattcatgtgtctgtgtgttgtgttatattaatcttttcttgcattgctataaagaaatacctgagactgggtaatggatgagaaaagacacttacttggctcacagttctgcaggctgtaccggaagcatagcagcatctccttctgtggaggcttcgggaagcttccagtcgtggcagaaggcagaacgggagcaggcacttcacctggctagagcaggagcaagagagacagaatgaagtaccacacacgtgtaaacagccagatctcagagaactcactcatcatcatgaggatggcaccaagaggatggtgttaaaccattcatgagaaatccacacacatgatccagtcacctcccaccaggccccacctccaacactgggaattacatttcaagatgagatttgggcggggacacatatccaaatgatatccatgtttaatcagaaaaataaaagttaacagtaacagtgattttactttgtagacctttgctaatggctgaaatctagctccattccgagaacagcctgcggtacacattttgaaagatagttgattaatatgaaagaagccttatctgtagtccttaaggccattatggtttacatatatgagtaaatattccaaagtagccatgccagttaacatatatccagagtctaaaggccactgggcgacaaaagtaaaagatacatagcaattgttactttatatcacagtaattcttgtatattttaaatggatatttgcatttgaggatatccacttaagagttaggtacatggctcttacatttaagtaacatttacttaaatttctggctgcagcaattccacataggtagaaatgaagtctgaattgagttgggggtctttgcagtgctctctctgttcattggctattttgacaatgctgagagatgtggttagccattctttttcatttcatattggcaacctagagagcaattaagccttctccccttaactagatgtatgttttactcatttctggatctttatggctgactttgaatcctagcctgtggtagaaagcatggtgtcagaaggaactatgagttaagactatgcatacttggctttgagtcttgggtatcatacctccctcatagagtgaaggaaccagggattcttcttgaggcccagacccggcatccatgttaagaatacctgtgcaattttgcttcctgatatttaaggtgaaaatgcatgtttgggtcattgtgaggattatgtgagatgttacttttaaatataggcccccttattatatgctctcatagtttcaggcaacacttgtcgtatttgtaacctcagttttaactgtaatgtttccatcaatgtccctcttacctggtacaggggctcttcatattcttggattacaaatctgtgaatgcaaccatgcatcaaaaatattcagaaaaacaatgaatgcctacctctgtactgatgatttataggtgtttttcttgtcattattccctaaacagtacaatgtaataagtatttatatagcatttacattgtattaagtattataagtaatctagagatgttttaaagtatataggaggatgtgtgtaggttgtatggaaatagtatgtcattttatatgtcacttgaacatttgtggatttgctatccgtggggatcctggaaccaatcccccatggatactgagggacaattgtattataagcagcaagagggaaaggaatctgtctattttgcccaaaatcgtgttcccgggacctagcatagctcctggcaaagagtatacaacaaatatgcattgaggagagaacagagggaaccattatccccttattctcgctgttccttcatgtaatgaataaacagtcaaatcttacaagagattttaaaccagtcagagaaaagttggaagttagttagttgttcatacattgagaagcctcgacgctgtgtcatctaggtaatgaaagatctagggaagtttagcagggagaagaagagagatgatagttgtcttcaaatgtttgaaggactgttacggacacaaaaatttaaacttgtgctgaataattccaagaggtacacagtctctcgatagaagctaaagtggggggtgacatttgactcaacaaaaagccatctaaatatcagaactttcaaaagcaggaactggtgcctcaattaatagtgtgttttctagcacttatgatacctgatcataggcaagataatgaaaaattgggacctgggagttatacatgggaatttgtttatcagttgggtgattaggagaggtggccttaaagtcctgttgtgttctaagagtctgtgattctgagtcttatttcccaacaagagaggtacagagcagaagatgggattgggagaaataggataaagataccaggaaatcctaaaggtaagaaaaggaaggcagacctgaagctaactctatacttcaggtgcttgcctagagccagccctacctacttagagaatgttgaagagccagttaaaacatctttaacacggatgtaaaacaaaactatcaaaacctgaagatttcgaatgttctaacctactcgtcagttgggcttttttcacaaatacttcagtaaataggcataaatttattttttaatgatagaaaatatctcttaaagaacttataactgtggataaaagcaccaccataaaaatcttgtggtgaaatatatatatatatatatatatatatatatatataaaattttaaatatggttagctagaatatgacgacaatgtttatgaaacacagagactcttgacaagtcccatgtatacactataaaactttaagttatccactattcactcactaagcttatacttaatgagtgtctgctgtgtcacttattgcggaaggcacaggcggtatagcattgcacaaaacatatgtggtctctgatggagtttttcagtctagtggtgaaagcagtgaatgggtgtacagatgttaaataattgtacaattagttgcatgtgtaaacgtcaaagttcagaagatgacaattgatctacggcaatgtttctcaatctctgacgttttgagccaaatacatctttgttgtggtggactgccctgtccactataggatgtttggcatcacaactgacctctgcccattagatgccaatagtactctcttctttaatcacaaatttgtcccagacatttccaaatgtcccttggggagcaaaatcatccctagttgaaaatcactggtctagggggaggtctttatgaggaagtaacatctaagaaagctggtatgtttacatatagctacagtctattacacatgtatacatatgtaacaagcctgcatgttgtgcacatgtaccctagaacttaaagtataataaaaaaaatgtaacaaaacaatacagtatgataagtgctatgggaccaaagatgaaagggttctactgcacagttatgaactcatagttaggcttttggggtcaaaattttgctgaagatatttgccacccacgtgacctttggcaggtgacttagcttattcatgcctcagttttatccaatgtgaaatggggctggaaagtcccatgtacttcctaataactttgcggaaataatatgtggttatataggaaaaaaaaaaaaatcctagaagtatgcctgctgcgtagtaaaaggaaggagaaggataaagagaaatctgcattttttcttctgtaatggggcagatagtaaatattttaagttttgtggcccaaatagtctctgtcacatttacttgattctgcagttgtggcattggaagcagctatggacaatacttaaattagtaggtgtgcctgtgctttcaataaaattttataaatacaaagtttgcaaaacaaagttgttttttttttttttgtagtttgctgacaccctagtaaagaagcaccattgtcaacgttaaaaattatcaaatttttatttttcaaagttttcaaatttgctttgcttggtctagctcatgaaataagtcaaaagtagcaagacctccacctctaaaataataatagtaatgataacctcaaaaggaaagaagaaatatttttaaagaagaaaaattattgttaaataggattattgtgcagagaaaacctaggagactcaattttaaaatctgtgaaataattttaaaaatactttatgaatagatacataatagcttttattcatattaatgactataaatgcaaatggaaatatttcattcacactgatgacaatgtataaattaaggaggaataaaaattgtagaccctataggtgaaaagcataaaaatatacataagaaaaagcaaaaattgactacgtaggattgttttaggatttaagatttattgtcattaaacttgcaataccagccaagttaacatttgaatttaatacagttataatcagaatgcttttgatgtgtttgggggcaatataatttcaaaggaaataggcaatgatgtaatttaaagtttatatagaaggaaattgtgtgcgtgtatgtgtgtgtataaattggaaacaattttattaataagcatattatggcagcaacatacacttccagatttctactatactttgaagtaattgtgatcaaaaccacagtgtgctggcataaggctagagaaatgggttagtggtttacaagtgagagtccaggaaaacatccaaataagattggatattttagttctgtgtggatagcctatttcacttaataaatagtgtctcgtaattgactattcatgtacctataagtttaactatagaccaaaaaaacgccctactagattaaggagctaactagaaatataaattcatataaacaataaaggaaagtgtaggactttataagcttcatgggagacagatttttggtaagtcaggaagcctggaagacttaaaacataaaattggcagactgaattaactgatagtttaaagcttccatagagcaaaataaatcataaaccaagttttaaaatatataatggatttagagaaggtatttacaaaaatatatgactaatggaggttaataataacaatatgtaagaaggatatgaaatggcattttactataaaggtcaaacaaatgacctataagcataataaatcatattaatctccactagtaataactacacacatctacataatatagatgttacgcctgcatttgatttactttatctgtcttttggcagaactatttgtcaccagataaaaaattctatatcattaccagaaaggtatattattataatgtttattatgttgcagttgtaaaagaaataacagcttttcaattgtttacaaatcctatagaacatttactgaaatacatttacattttgtggcaaacttggatttaaataccgtgttcgtgctttgttttatgccgttttcccatcttttctccaggaatttgattgtgcttcattgaaagctaaaaagaaaaaaaaaataattctggttttggtttaaaaaattaggttaggggttaaaaagttgtacgttgtcttctgtaaaaataaaaaacaagttttctttgtttcttggaggctttatattaaatggatttttaattcatagacagcatattgtgatgaaatttccccatgagcttcacattttgtttcaatagcagaaactaacttggttgcagttactgcccttctgagaacagtgttctggaataattttgacatacatatgtatctctttttaaaacatgtgttaatcttttcataaagaaagttttcccagctgtgtcacctgtgactccaactttctggggggacagggatatgagatgttggaagggaatggcttgaagaaataaagtgcaaaagacgtaatgctttcctgtggtagaaatgtattcagtgaccctgaatgaccttcctactcttgtcccttcatttttcccacaagtatggtctgggcaattataaaaattgacatttgcagtgggctcttctgtaaaagatgctcaatcagaaatgatttattttagaaaaagagatgatataaacatatatatcccctgtctcggaagtgtgaaggttgaaaagcaaggagatgatcttcaaagtgtctaaaatattgatttgtaacatcgttttatgaaagtgcttcagattattttttttcttggatggccccttatgctttggtcagttgatgctaaaatctgaacttctttattttaaaaaaaacttttaattttgaaaaaggaagttcacggtgctgtctaattctttttagatagtcattaatgtaaatgtaagagtcattctgagaaccacatctgctgatatgttccgttaaattacaagttctatgtgtatttgctttgctttcatacaatgaatcttctttactctcttccccacctgccagaaattgccccactcaacgttcataaaaggtccattttcaatcgctatatttatttcagaagcagagatatcatatattcaaattttagttactttccaatatcaagctaataactcacacaaataaatcaaactacagcaaaacagcaatctagcattcaacaaaacctccccaatgcacatatttcaagctgtagatatgtatcatccaccatgctgaaataatgtacatgttcaaatcaaatggaaaactagaatcaaaattgttgattacttcttatcagggcattttattatatttaagaaaaatacaaattaaatcattttcaggaagcaatccttctggctaagatttttttagcataatgcttaaagttaattgttgatctttatctataaattcaaaggtggactaaaaatgcagaatcaatcaggtagtccattttgcatcaggtgaaatatataaagcataaaacagcgagttacatttcctaacaaaattgaattacagtgagtaaaagtgacaggacaaatgcattaagaaaagatggactgaaatggatagagtagaatatatgcatctataaaacacagtcatatataatacactcattttttttcttacgagtgtgagattaatggaagaaaacaacaataataacaaaaccagtgtgatgtgtcagatttcaccttttaattaaaaaattattcacttcagaggggaattttctttcttgggttagctcaatcatgtcagatcttgttcatttaaaaggtcagtttacttgccttctgaggtttttgtttgggaaaaagaaaagaaaatagattttcattggtatcctgggtagaattaattgtttatcattcatttttaagatctccgagaggcagaaaaaggggaactgtgcaacccttttgtccttctggatctcaaaatgaagggatacattctgctacatgaaatgtggaattaagaccatgatgcaacatgataaacaacacaaatttgggggtgtctctgtgctatacattattgaatttttccatgctatacactttttggatgtgtctgtgctatttattcagtttttttaaataaaagtttttgtagactaaattgccctctctactttgcatcgtttttgaacaaaggattttcaagactgataagctcaaatgtatcatttattgtattcaagtagcattcaatttttctttagaagtataatttgtagatattttaacacagaaaacttgcaacactgctcatgataggcacttattatatattttttgaaagactatatggataatgattctaactttgacttttcctgttttgccttcactttagaattaagcagagaatcaaatccatattcctgggggcgatgcttggacaacagtatctctttaaagatctttgtgtgagtcgaaggtgcagccagactgggagttattgtgaagaaacagattcaggaaggttgagaaacttgcctaaggctaatcagatagttactggcaatgttgtttctaaatcactgtttggctccctcattcaatgaatctacactatgtgggactgcctcttgctcctgacatcttttgctgctgaaataaatgaactcaaagcctagaaggtagaaaagagggagttcagaattatattcaggcacaaataccaataaggctattgcccccagaactgcaacttctcttggtttaacagataactatttagctgtgaggtacaactgaggaagtggacacacaagttatcaggagattctgatgtgccagtttatatttcttgtcacaggtaatgattcgaaatttcttaaaacagctgtcctcacagtggagtaacctgggagtacatgaaggcattccaaggagtaggcacagatagttttaagggaatttatttctagatcttctactttattttgtactcttcctgaaaactgaattgcctgaaaaaaaaaaaaaaaaaaaaaagacatctgtagtcaagacctcaggctgtttctcctttctaaccacttgccttttctaaccacttctcccaatttaagaaaaaaagccttatatttcatccaactctgatcttactaaggcttcaaacaaaagaagcatgaatgactttcatgacagggcaacatagctttttgcaagaagagtggttgctaactctttgctttcaactgaacccgaagagaagacctgataagttgtcagccgatagatcattaaaaatacgttttggtaagcaatcatcatgtacttttagcatatgccatagcaggagcacaaatgattaagcaatgctactataatacaattccttccgtttctttctactcacctatttgaataagatttttcatcatttacatctatacagacaaaaattagggatagaattgatgctgaagcctttccaattgtagaattaatttatattcttctgaaggtgtataaattgttaaatacccatccatcttattaagagatgtattttcaataaaattttatttttatgtttatcaaattttataatatacatatattgttttggtcaattgcacgttaataattgtaacaatacctcaattgaaaaggtttgttttttacatttaggacttacagtaacagaaaaaaaacactcattgtgtatacatactgtttaagaaaagtatactaggtgatcaataagattttttcaggcataaacatatatcttagttttaagatatcgatatttacaatgtccctcaaattatattattttcagtcatttaagaatgaaaagtacatttcgaatgcggattttaaatctgcaagggttgactcatttttcaagagtctttttaggggatacagaagcaagaatgtttggagttccctgatcagtatctttaagagaaggtatttgttggtagttcctagcaaattccaacagcctgatgctacttaaaagataatagtaattattttaaataatgcttctgataaaaaacattcatgcacactcagtttaaaaagatatttaaacatttgtagttgtagtttgggaactcatgatacaagtacagtctgtaaatgaagctcttagtttgcaaatatcagagataagctattaaaatgcagaaattgaaattgccctgatatatgcataaattagtgtcatctccatcttgtcagttagagtattttttagattctctctatgtatacatacatatatatatatatatatttatatatatatatatatttgtgtagctgtgcatgtgtgtatttggactaatgggtcaaaggacagtactaacccaattcaataattaaagaaaacataattttgagaattagctttatggtaattgtttgacttaaatgagtagatcagagaagaataagggctttcccttatttaaacaagcttcatttttttatccaaacatttacttagctgattaagcttcacttgtttattttcttcaaagcattcattcaggtgggtactgagtaaactgaaatatcacaccagggaacttcaacaccatccaagtcttaaaggcttcacttgttcacagttggcatttagtgaatgtctaggctactgataatattgtgagtaagttggcagggatcataagaaatgataaaatacagttcttgaaaatgttatggtttgaggaaaagatctatgtttggaattagactgacttggattcaaactctggctgtacctttgggacaaggtgttcagaaactctagcctatgttttttttctgcaaaatgatcctcttttccaggattcctgtagagattcaaagatatgtgaatgtttagaaaaagaatagacttttgatcattgttaattcccttactttccccaattagacttgtaagactgggaagaaagctacacaaaagattgaacaaattatagctgacagaccatagcaaaagatacagggcaaaacttaaaggggaaaactacacattaaattattttaaaccattaaatagcactaacttttgtcagatattacaaccaaacaccactcaaattaaagtaaactgaataaaatgcctgtttttttctgtttactgatgttttcatttgcttcattcatttattggaagatataaaatgtgttagacactgttaggtgctgagtgtataaaaaaatcttattaatacaatttaaacacgcacacacatatatatggttataacaattgatgccatgtatgtactgtttatatgcctatacattattccacagacctggggggagggggatgtagagtcttaccagaaccataggaatcttctcacatcaacatttccttttgaagtttgttcatgaggcaccatccagataatactaccatctgcaatgtggcttgagaagatgttagatttttttattacacataataaggctgtaaagtatttctgtatttaggtagaggtatgtaatacaatatgtatataaaattacatatccaataaaatctggtgttaaataaggactagcttctatgataatatagtctaaaggcttttcatttggtgttatagaaattatgtgaaatatgtttcctggagtagaattattcgcatttcagctctctgacagtggaagaaaagctagagggagaggtgaacaagagagggagcataatggacaaagctttgctggaagccaaaccaccacttcatatgtcaaatctgacaggcctcccattttaggtgtgctgtcattgaagctttcagctgcaccttgcctgtggctaggctattttcaaagattaaaatgcgaaactggaaattaaatgcaacttaattcccaatttaaatttccattatttttgaaaagtaaaagattaaaagaaatgtataattgcaattctggtggaagaggtaattataggaaaggtgggatgtatttcaagtgggggatatagcttactgcagcagagaggaatctaagctatcattcttttgaaattggtctggaaatatgttttcacatggaaaatatactatatttttaggaatttccttgtcatattactgtatccttttctgttagaatataaattctgaattccctattccactgtagatctgcctccgattatattagctcttctgaagttatcaaaaaataatgagatatacaatattccatatatgtcaaagcaattatttttaggttaagtaataaaccaatgacctttaacccggtaatattctgggttgttcataaaaaaactatattcaggtaataatgtctttccacttaagcaactgaaaaaatacacaatacttaacatttggttaattaaatacctactccagacaaaaggattttctgttttcaagttatcttagcaagctgagcaggaagcaatgatatatccaatcagaatatccatggaagctctgctacagtttcaaaaagttctcatcaggcagcttttaaaatgcctactctgaaaatggtccaggttaaagaacaacagcttcctcgtcagatagcagtattgcttggccatgtttcttcctagcacaaaaaagtacctgctcttctctgagtacctacattctaaggactatggcttacataaaacagcatgggttggggcaatttccagcacactgctcactctcgaaaacgtatgatgcaggtgagagtaatgtttttgtttgaatctgctttcactcgtggaagatgaaactacttgcaaagatctgtactttagctattatgagtaacaaaagactcctaaaatattgcacacattgtggggatggagaaccatcatcctgggatttgatggatcctatggtttggctttgtgtccccacccaaatctcattttgaattgtaatccccacaatccccacatgtcaagggagagagaccaggtggaggtaactgaatcatgggagcaatttctcccatgctgttctcctgatagtgagtgagttctcacaagatctgattgttttataaggggctcttcctgcttcactgggcacttcttcctgccacctgtgaagaaggtggcttgctccttctcaccttatgccacgatggtaagtttcctgaggcctccccagccatgctgaactgtgtgtcaattaaacctctttcttttataaattacccagtctcaggcagttctttatagcagtatgaaaatggactaatagagacgtgtctctcagaagtcacagtgatgcttgaacggatccagagctccttcttcaggaaggtcccaactcattctgaagggtctctccaagcccacctctctctgtaaatgggaaaggttttactttgagcactaaaacctgccagaattctcaattttcctaacagtgtgttaataaacacctactcatttagtatccaaaccaggtctgtatttctcaattagagctcaccaggctttcatcataaagtagagcttcaaattgtctgcaatcccactcctatcaaaaacctagaaggaggtaatatttcagagtaatactataaccagatgaccacatctaagaaactgctgaccctacgatgtaaccttctgtccatttttccctttggaaagtctaggatcttttcttataccagcaagttacaagcctggactacactaacttgctttccgcagaagaaaacaccatgagttctgttttcatattaagcacttagtctccatcagacatcaatcgagaaaaaatcattaaaaatcacattttatatttgatgtatatttctcaataatcctatgtattagttcattttcctactgctatgaagaaatacccaagactgggtaatttataagtaaaaagaggcttaatggactcacagtctcacatgactagggaggcctcacaatcatggtggaaggtgaaggggtagcaaaggcatggcttacatggtggcaggcaagagcgtgtgcaggaaaattgccctttataaaaccatcagatctcctgagacttattcactgccataaggacagcacaagtatttagctccctcagcacagaaccatccccgtgattcaattacctcccaccaggtcactcccatgacacatggggattatgggagctacaattcaagatgagatttggatggggacacagccaaaccatatcatcctatttggatgatcaatattatcaaggtatgctcccctgagggggcgtcctttttaccatttaactccaggacaaaagtttatttctttgtaaggacagtgtttatttcttatggtcctattttctcctaagatccagacaccaaaatggccatctatcattgacttaactcctgaattttgcttagagtaacagatttagtgaatctaaatattttctggctgtggaatgttaatttatacatgttcaagttacctttgattcatgtgacagtttgtgccaaaacacactcattatcagaactcagatcattatgttggctcttgttttcgttactaaaggaagaaaaacagtttctcaaaaagaaaattctgatacctaggaagaccattatacctcactcttttctttatctcatcaccacatccaatattataaaagaacttacaaagtaaaaagaaaggtgttctgtagatgtagcgcctggcttgtatggtagcttaaatgaacacagctaaaaatattttatggctagtgtccaaaacagtctggcaccagacaaaataagaatatttaaaattatattttagagttactttaagaggaagggagagagagatgtaggcaggaggaggaggagcaggaggagagggagagagagagagagagagagagagagagagagagagagagaatctggggtttctatggaagggctaagaatatgtagaaaacagtttacaaagaaatatggtccaagaatcgtgtgtacacacacacacacacacacacacacacacacaccccctggaatatttttcagccttaaaaagaagaagatctgtcatttgtcccaacatggatggacctggaggaccttatgctaaatgaaataagccagaccaagaaagaaaaatattgtatgatctcacttatatatggaatctttttttaaaaaaggtcaaatatatacagatagtgaattaaacagtggttaccagggtcagggtagttgtgaggaaatggggcaatgtaggtcataggatacaaatgattaaaatatattaatatattaaaagatataatatacatcatgaggactacagttaataatagtgtgtattcaagatttttgataaatgaatagattatagctgttcttgccacagagtgaaaaatgggtaactgtgaaatgatagatatgataatgttctccacaatggtaactattttacactatatatataaatatctatgcatcttacaccattatgtggtatcccttaaatatatacaataaaatttattttacaaacacatattaggaatgcatattctgatttttaacaatagttaacctcattaatatatttcacactatcatttctagtgtacatgaaaagtagtttattgacattagttgtaaaaaaaaaaaaaatggtcttgagacttttgggtcagagaatgttctggccataaggtaggtttctgcttgcctactagatatcttaacttcgatttcctgaacatcccatcacttcagaatctctcaatcctttctaacatccgcaacattgtttttctttctgcatttcttatattgactgatggatttataattcactttctctgaaaaaccctgcagttatcatatatccctatccattctggctctttattgcccaaatctctaccaaaatcctgtcagcacagcctctgaaatatttctcaaagcatttataatctggctctcatcaacattttcaacactctgttttatcattccactattttacatcatttcattttcatttttaccacaatcactcatccaacaaataagtatttagctccctcagtaattagtattattattattaattataactagatgctgagcatacagaagtgaacatgacagacataatcccagcagggatgtcagactttatgcaagtaatcaaccatgatgaatctcatgagattctgagagagagagagagagattgagagagagagagaaaggggaaccactggtgtccgagttagaaatttgaattagtatctgggtcaccaaaagcttctgtgaagaagtgatatagacttggccacacaaaactaccgtgaaggtggtggaaatttttctatgcagagtaccacatttaaagagctaagcctgagagtgtcagagataaaggaacagaaagaatgtgacagcagattatgtttggaagaaagatgttcaagagaccaagctaaagaggagatggggctagaacctggagggtccttcgggtcctgttgggagttttttctctgcccagaagggctttgtcacgtggttgtcaggaaagagtcatgattagagctttgattcagagacttctttcgctgaagtgtggagaatggttcagagagaagcaaatctgaatggacaaaagaggttattattgtaatcttggcaagaagcgatggtggtcttgactaaaatagttctagtgagaatgtgacaacaaacctgagaaaaatacaggagacgtaattgacgggggttagtgttaagttgaacgattgcagagttgaatttgaggaaagtgtcatatatcattcccagtttctgatgtcatacacctctggagataacactgccatttcttttgaaatgggaaaataataagtgatcagtaagtacgtattggataaaataatgaatggttaaatgcataaggggagaggaaaagagttgcagagaaagagagtaaacgtattttggatgtgttaattttgagatacctttgaaaaatccaagtgaggggttgggtagtcagagaaatgaatgtggatgtcaggacgaaaggtgaccgtgatgaactgtatgtcttcctctaagcacgttatacagcttcatgtcacaagtgactcacttcatgtcacaagtgactcacaaggtcacttgtgacaagcatttgcctggtgcttcatccctaacctccctttctatactcagctaaaatgtcacctacaatacttcttccttgactccaccgtccccactttactgatatgaatacattttaataaaatgatataataatgcttagtttgtaaacctaatgttcctcaagtggtataattatctgatttgtatgtgatcatcaacccaaccatattaggagcaccttgaaggtagaagatttaggttcatgcttaacaccacatctggaccactgtggatttaactttctacaatgattgtattcattaatatattgggtgcccactatattccaagtaatatcctgcacactacgtacaaggaagcataggtcccgtgtgctcatgaaactgtaattttagtaagcagggataggatacaaactgagaaaggaaaacaatttagaaagtgggaaatattatgcacagaattaataaaaaagagaaaaatcttgaaaaagtcttcaatacctcacttggaaggtgattttgaagaagaactgatggacaaactagagtcagccatgtaatgatgtaggggcaaagcattccgggcacaagggacagcttatgcaaagaccttaaaaatgaactagctttgtatgttggagaaggataaagagaactaaggtatctataaggtaattaggaagaggatgagttatttagtcccttagtctttgaagcacattatctcatacttcaattgagtttattcttagtgtcattcttctggatgcaatatttgagataaatgtcttaatgaacgttcacctccctccgtagtaatgcctgagtgtcacaaaaactttttttgtttacatacgtagccatctaatggaaacataaaataggaatcaaaagttgagtttcatgtacaaaaggtaaggactgtacatgtggtcataacaacttcaaaagcacctgaaggtaacctttaaggaagatacaaaggctaggaaatatctaggatccatgaagacagacttacttaaggtcatagtgtgtccagagttggttcccgccggtgggttcgtggtctcgctgacttcaagaacgaagccacggacctctgcggtgactgttacagctcttaaaggtggcacgaacccaaacagcgagcagcagcaagatttattgtgaagagcaaaagaacaaagcttccacaacgtggaaggggacccaagcaggttgccgctgctggcttgggtggccagcttttattcccttactgtcccctcccatgttccatttctgtcctatcagagtgcccttttttcaatcctccccacgattggctacttttagaatcctactgattggtgcattttacagagcgctgattggtgcgttttacaatcctcttgtaagacgggaaggttcctgattggtgcgttttacaatcctcttgtaagacagaaaagttccccaagtccccactcgacccagaaagtccagctggcctcacctctcaatagcattaagaatatagtttcacgagcatatatgaatcaaaacttacatttgccaattttatttgcttgtttatgtgtttccaacatgtcttgtcttagggccaaatgtttccctagagaataactattccaactatcttagttgctgtatttttatgcaaccttcaactctccatactaaaatgtctccagaatagaaaataaatcttttcaaagtttcaaaagaggctctctatatattccccttaaaagtaccaggcagacatatttctaggtttctaacattgcgtgttgccaggaagtatatccaaaccatcacaagttattcatgtaaccaagcacacttattggagtgcttctgcttctgttcttgcttgaaattggaagctccttccaggaaaaaaaaaaaatatctatagaaggggaaaaaagtaattttactttgaaaataaaatatacgtgagcaatagttttattctgtttttaatttaccatagcttccaaagacaacattgttttatagtaggggttagcaagtgttttctgtaatgtaaacgtaaagggccagagagtaaatattttaggctttgttttctatactctgttgcaactattcaactctgctgttagaatgttgaagcagtcatagacaatagagaaatgaagatgtgtcattgtgatccaataaaactttatttacaaaaatggcaatgggctagttacggcttgagggctgcagtttgcagactctcacttcagagctaacagttgttgtcaggagtcacttgtttttggaaacctacaatgaggtactataacaccaaaaagagttatcccttcctttttctctctcactttttgaattatgagaagaattagaaatgtagttaatgataatgtccaaccagtgtaattatacttgttagaaacacagctggaagcctgttgtccagtcttatttctcctctgtgatcctcattttcagaggttgaagtcataagtttgccatgtctactttctgacaggggaattataataatgtggagtcaccttttgtttgtgactttgacaatgcttcattgacttactcaccaattttctaatttttatgaagactttttgccgaaatgtagactcagtcttctctcttgtctactctttctataacaattaacaatgaacttatttacctttttaacatctttttaaaaattttctatacaccttgaaaatgtgaatacaaagtaatgctgcatcatgtatattgccttattcacacatagcctcttatggtatatcatataaaaatggaacaatacagcaacaggttgaatgaacagtaatcaggtaacaggaaaatgagatgtctttaatatttcacttaaaaactcaatttcctaaagcatacatataaatatttggaagtatagttagaagaaaaatatctttaaaatattttaattgattagtcttatttataagataatttttaggaggctggttgcggtggctcacacctgtaatcccagcactttgggaggccgaggtgggcagatcatgaggtcaggaaatcgagaccatcctggctaacacggtgaaactccgtctctactaaaaatacaaaaattagccgtgcatggcagcgcatgcctgtaatcccagctactcgggaggctgaggcaggagaatcacttgaacctgggaggcggaggttgcagtgagccgagatcgcgccactgcactccagcctggtgacagagctagactccgtctcaataataatcataatcataataataatttttaggaagcatcagaaatatataagaaaaagattattttcttaattgctttactaaaaacacctctatgatttttcagtaaaacttgattcttatgtcatgtgtgagtgtgatctgcctctcttgggatactactgtactcatgaggagtgatttttttctccaacgacctctttgtcacgtcaacaggtcacaggaatagtgtaccctaaaaagccacctgccacatgctgctgaaaatgtaaaagtacacacatacacacacacacacacacacacacacacacacacacacaccaaaatcaggtatcacaagctgaaaataaaattgagtccaatttttttttaattgagcagttaatgtccttaaaacaaaatcctatactgcaacaaatacttagccagatcattctgatacctccaaactgtggtgtattccaagatacctctatgatctttgatttgatccacagcttttcagttatcatgcaaataccttcaagttttatctcatttctcagtgcaaactcattaaaaattttcagctgaattcaattttataaacatgttgtgaatgtcctctttatataagcaaggttgtaaggaactggccacataaacagaaaattgaataacatatggtttctggccttagtgatctcatgtgtgagttaggcatatgggcaaaatcagaacactatagagtataagtctaaaatggtagtattttataatagaggatgaagagggtgctgtgggatcataggtgacagatataactcccgttgtgggacttgagaaaggcttcacagtctggaaacatttagttgctattgaacacaaaataagactcactgttgagagaagggagagggagggcatttcaatcaaattaagattctgtggcatattcggaaactgatgtttttaaaaagagtaatgtttattacattcctctacataaattatatttctatgtaatatgaatgacaaatatttaacacaaaatgccttataacatttgaatgaaatccatcatatgacctgttatctatttccatttcctttttgctcatatcattatgaacaatgacctgataaattttttataagactttgctgaattagtaaaggattattaagtttagaatgaacaaagctgaccaatcattcaggcaaatttgaccgttttgttgtcgcttttcttatttctgaaaccatacaattccctgaaatgaataagtacatatttgataacttcctaaattaaggctcaaaacactggtaatctactgggctttcatttgttccttctatttgtctaatcctatctatatttctttatatgagctatgaaaatattagatttattaagttgtcctttatcttaatagagaagaatgtttttctatgacattaagaggaatttgatttttttctttaatgatctacttttaattttggtagagtagcattgataagatcaatattacacattgttaagtatgcattacatgttgataagataaatattacacttaaaatatgtttatcaaatgtatgaatgataaaaacgaattctgaaatgtatgggaaagatcttgaataaaggtctatgtacatttcaaggatgtctacatatgcaaattatcataatataataactattgaatatgattatcttcacatactttctttatttttcatctcttagatgaaattgggtattgttttcttatagctggaacaaagcattacagagaattcttagtgtgatttcattgaaactcactgttatatgagttcaacaaagtttaaattagtccatgacttaatcatcctttataaatcctatcactagtattcggtaaggacaaagtcaattaaaaaattagcaacagaagcattaaaagaaggattaataaatacaaaataagggatgtgatatctttacgtattgctgagatgttagtgctaaggaaaaacttccctgttcataatgtgaggtgggaaaaagaagaactattattgtatatttctcctctctaaaactgcctatctgactgtgtttttctgtgtcagccgtattaacagatgtttaattttactcactttagtatataaggcatcataatgtatgaactatttcaaaggccctatgatggctaattaaataaaaatatattaaatattagctggacaaaataaaatatgtattaattttggaaaaagtagatcaaggttttgcagatcttttcatatcaatatattcatttgctgaataagcttttattgtttaccaatattactagttttatagagatgtagatatcaccacagtatgactaattttatagggacacagatagatagatgttattttattccaatcttatttttacatataacaggtataaatatgcgcttgaaaggagtatatcacttaggagtcagtcagaaaagtaaagatcttctagtctaatacagtggttctcagccaggggtgattctgctgcacgctgagggataaattggcaatttctggagacatttttggttgtgacaattgcaggagtgttactggtattcatttggtagagacagagatattggtagacactgtacaggacacaggaaagtctcttacaacaaagaattattctgtccaaaatgtcagttgtggtgaggttgggaaacactggtctggaagaaggaatttactatgaggaactagttacgaaagtatagagacatttaacaagctgaacaaaggatagtgagatggctcagagattagcaactgtggcatgaagccactactacgtttaggtaaaaataagctaccatttattcttatagtaataataataataattattattattattatttgagatggagtttcgctctgttgcccgggttggagtacaatggtacaatctcgactcacttcaacctctgcctcccagattcaagcgattctcctgcctcagcctcctgaatagctgggattacaggtgtgcaccacccctcccagttaattttttgtatttttggtagaaacggggtttcaccatgttggtcaggctggtctcgaactcctgacctcagatgatccatccacctcagcctcccaaagtgctgggattacaggcatgagccaccacacctggcccactctttcttttttaattattgagaaatataaaaatatgtcaaaagtaacaggtgtggtggagttacagcatgcacataatgggatacagcccattatctaatctcagatggaaactagaaaaaaaagagaagatctttgctaaagcacagattatgtggaaaatcatttagaaaaatagcttatcacaacattaaaattaaatcctttagctgatcatttttccttgctattttttcttttaaaattgagaagacagtgagttttttttctttattgtcattatcttgatgtcaaaaaataatatgcacattataagtgggaaaaaagataagtcgaaatgaaatgaaacaatgcgaggaaaaaaatgtcacaacactcttcaattagaaaaaatgacccccatctttcctccaaatagaaatgacgtaactgaagtagtggaactttctcttccatggcaactctagagaaggggtagatggcatgggattgtggacagatggacacagaaagaggcctcatttattgttattgttaaaacttttacttctagtaatagtgacacctccttcagcatttctttatcaattgtcaatattttttggatcaccagcatcaccttctatatgtatgtctagaaacctcctgttatgaatttacacttctcagagtcaagacagaaatgctgtgaattgggcgataaataaaataccccccttttattgccttgctttgtctcttaaagaaagatgcctgttgggggactatgagaatgctttgtgcttctggacctcaagggacaaatctataataaaaattatgcatagtgatgagaaatatatataatgcaagtttgtagagatcagttaacttatcttgtctaggcaattatttctaaacaatgatttcaaatcattaactataatatagcccattcataccctccatttttgtcaaatccctgtcaccttcaaggacttggccatcccataggctgctctgcttttaatagaggaagatgctgtaactcttggtaccattgccagttatgaatttatccattaatgaacattgcatttaaggcataggtttatctccttctccaggtatgaacctgcaggattcctacctgaagcttaagggagaataaatccacctgggacaatcaaggacagatcaaccaatcagctcaaagcaggtgtgaattacacagtttatttgagtgacaaggtagctaaagcagggataataaaagaagggagtgggttgatgtggacagacgaactatggctttaggaaatttggtagggactgaaacatattttgtgtaatttatgtgggtctaatagcttttgaaacttgtttacaagacctgtgtaagtggtactggcatattcatgcatgagaaaacatcaagggaaaacttaatagttcaaggaggtgacaaagaagagaggaaccaattattttcactagccgtcaaaagcaagaaaataatcagcttgagcccttcggggaaaagataggttaaatattaagtaacagtttgttattattccaagtgttttcttaaagttgctcccatactttcctgttttctctgagggaatttagtttttttgttggtttttttttttttttttttataactgtcattggtcagagcttgatttgatgccagtcaaatttttttaaagagattatgaaaactgcttaaactcttccaaagggaagatgggtcattcttaacatgtgtttcaagaggaagagcataagagcattatatggtaaggctgaaagcagatatcagcgtttaggggccatgaagaggtagagctcacattggtaggatcattgactagaattccagagatcaaaattgtatgttagtctagcattggggaggacttgtagctagtatcttcattctagcttgggagcctaggaatcaggttaggcatcttgcacaggaatgggccgatgggctaaaatctccttgagagagatgattaatccaggacaaaccaagcagtcatgccaatgaattactttaacagggtacttcatatcctcatcctttgggcagcacggtcttcagagatggggcaggccccaggctgcagttgagattctataaactaaggtcaaaaagatgcagcagtgaagaagtcatgcttatcttgtataaatcatgttttcttttctttttaatgaaaatgtacatttaacacattttaaaactaaatattgaccctaaaattccaaccaaaaaatgctacataagtggtatttatttttgaatttccctcatgctcctcccactgtggggacaaggagtggtggtggaagagagatcttttagcaaacctgtgagtagagaattagaaggtaatgggaggaaggtaaaaggaaaacatcatagatggataggctcacaaacattaaaggccttcgtgcctgtccttcatgcctattcatccctctccagtatgtgaatcaatgtacttgttaaatattcattcacctcacatatttagcattaaccgtgtatcagggacgttgttagaccgttggtttacgatgatgtgtaaaatatcatttgtaactcagactaactggaagtgctcaatataataagatgtaatgttatggaacactaagtctgtgctgaagacttatctcctttaatcctaaaacaatcctggtgggtagtctcaatgatcatctccaagtcacagttgaggaaattaaggcttcaagaagttaagaaactggaccaacatcacaaaggtagcatcagagtgacagtttgatttcaaagtgtacttgacttcaaggcccacatttccttgcacgtttaatattgcctttctcaggtaaatataccattaaatgtgatacaactctaagcatttgaattacttacaacgtgcagagttaaaaccagcattatttacactatacttcagctcgtttataagtgaactattattttgtggactaacctatgaaatgtaaccacattgaattcctctgttaggtacaggtttggtgattccagggaatagagtatgactgaatgcacaggtaggggtgaagtgaacccggtcagaaaatttagagagcatcgagcagatcattaagcagctgtctttcaaatgtgcagaacacaactcatttgtaatctagggactatctgtattgattcttcccagggaagttacttatttttatacatatgtggtgtgttctgtccataataccattctacatggtaatgctcaactttattatttaaaaaaactgctaataatgaggtttttctttgtatcacagaagcagcaggagcaagttttctttttccttcccagtttttttaagtactgccaaggaatgtgattttgtcagacttgtatttcctattaagccaatctgcatgactgttccttctactagctttacctgttcactcatttattaattcatcaaatatttgtagagtgactattgtgtgccacatactaatataggcacaaggataaccaaaaacagacaaacgctgtcctttcaaggagctcatatagtaatgggaagttaggaaaggagaaaataaatatgtggtatttcaaatggaagtattaaagtgttaagaagaaaagagaaactaacaagatagggaaaaagtgacaggaacatgatgttttattttttatttatatatattttttgagacagggtctcattctgttgcctaagctggtgtgcagtgacgtgatcatggctcactgcagccttgacctccctgggctcagatgatcctcccacatcagcctcccaagtagccaggtctacaggcatgtaccacgatacccagctaacacgttttcttttcttatagagacagagtctcactgtgttgcccaggctgttcttgaactccggggctcaagcagtccacccacatctacctcctaaggtgctggaattacaggcatgaaccaccatgcccagccgaaattgatgttttatatatggcagtctgggcagacctctttgatgtgatatttgaacagaaatctcaagagagggagtgtattagcccgttttcataccgctagaaagaactgcccgagattgggtaatttataaaggaaagaggtttaattgactcacagttcaatatggctggggaggcctcaggaaacttaaaatcatggcagaaaatgaaggggaagcgaggcaccttcttcacaaggtggcaggaaggagaagtactgaggaaagggggaagagacccttataaaaccatcagattttgggagaattcactcactatcatgagaacagcatgggggaagccaaccccatgattcaattacctccacatagcctctcctttgacacctggggattatggggattataaggattacaattcaagatgagatttgggtggggacacaaagcccaaacatatcattttgctcctggcccctcccaaatctcatgtccctttcacatttcaaaaccaatcatgccttgacaacagtactccaaagtattaattcatttcagcattaacccaaaagtccaagtccaaagtctcatctgagacaaggcaagtctgttctgcctgtgagcctgtaaaatcaaaagcaagttagttacttcctagataaaatggaagcacaggcactgggtaaatatacccattacaaatgggagaaattagccaaaatgaaggggctacaggccccaagccagtccaaaatctatcagggcagtcaaatcttacagctctgaagttgtctcctttgactccatttctcacatccaggtaacactgatgcaagaggtgggttcccatggtcttggtaagctccacccctgtgggtttgcagggtagagcccctctcctggctgcttttacaggctggcattgagtgtctgcagcttttccaggcacgtggtgcaagctgttgatcgctctaccattgtggggtctggtggacagtggccctcttctcatagctccgctaggcagtgccccagtggggactctgtgttggggctccaaccccacatttcccttccacactgtcctagccgaggttctccatgaggtcttcattcctgcagcagacttctgcctggacatccaggagtttccatacatcctctgaaatctaggcagaggttcccaaacttcaattcttgaattctgtgtatccacagactcaacaccacgtggcagttgccaaagcttgggacttgctccctctgaagcaatggtccgaactgtaccttggccccttttatccatggctggagtggctgggacacaaggcaccaagtcctgatgccgcacacagtggtggggttgggggggggacctggtccacgaaaccatttttgcctcctagacctctgggtctgtgatgggaggagccgcaatgaaggtctctgacttgccctggagacattttccccattgtcttgcctattaacattgggctccttgttaaatatgcaaatttctacagccagcctctccagaaaatgggtttttcttttctactgcattgtcaggttgcaaatttttcaaacttttatgctctgtgacctcttgaatgctttgctgcttagaaatttcttctgtcagataccttaaatcatctctcaagttcaaagttccacagatctctaggtcagggtcaaaatgatgccagtctctttgttagtcatagcaagaatgacctttactccagttaccaataagttcttcatctccatctgagaccacctctgcctggacttcagtgttcgtatcactatcagcattttggtcaaaaccattcaacaagtctctaggaagttccaaacttttccacattttcctgtcttcttctgagcctcctaactgttccaacccctgcctattacccagttctaaagttgcttccacattttcaagtatctttatagcagtacctcactacctcagtaccactggtcttaactcctgcgctcaagcgatctgcttgcctccacccctaaagtgctgaaattacagacatggtccattgtgccgagccaaaattgatattttatgtatgacactctgggcagacctctatgaggtgacatttgaacagaaatctcaaggaaggggagaaattatccatttacatatttggggaaagagcattccaggtagaagaaacagaaaatccgtagtcttgaggaatgccgtgtatatgcagtatttttcaaacttgttattttgaaatacatatacacttacaggaagttgcaaaagtattaagaaagatcatgagtacccttcactcatcttcagctaatggttacatcttacataattatatgtaatatcaaagccaggaaaccaggaaattgatgttgatacaatctatgctttattcagatctcacatcttacatagctatgcacaatataaaaaccaggaaattgatattaacacaatctatgccttattcagatctcaccagcttttacatgcacttatctgtgtctgtcattctatgcaattttataccatgtttagagtcatataacaactacccctattttgatacatggtactgaatagttccagcgtcacaaaggaactatctcaagccaccctttaattgtcacacccatccaatctcccattctacttcctgaatcactagcaacccctaatctgttctccatctctatgattttgtcttttcaagggagttttctaagtaaactcatttggggaaagaaaggagatgaattgttctagccacggagtggagaacagagagtaagagtacctattgaagcagagggagtcattgcaataattcaaatgagaaataatggtgattctaaaccaggaagctttcagtgaaaacaatgagaggtacatggattctgggtatttttggaaggtagcactaccaggtttgctgatgaatggggtatggggtgggaaagaaagagaagagcccaggatgagtccaaggtggataaggtgaatagaattgagaaaatggtagaaggatcaagttagatggtagaggggtaaaggtggaagcaataattttgttttggaattgttaggtttgaaatcttgttagacatcccagtaaagtcacaaagagtgcagttggatgaaagtatgggattcagggaagaagtatgtgctagagatgcagatttgagagtcatctgtgtggaggtattattcaaattcaagtccccttggaatgaatggctattcaggcagggtcttcataaaaatgcttgttgcatgcctgtaatcccagcactttgggagtctgaggtgggtggaacacttgaggtcaggagtttgagaccagcctgatcaacttggtgaacccccatctctactaaaaatacaaaaaaaaaaaaagttagctgggcgttgtggcacatgcctgtaatcccaggtacttgggaggctgaggcaggagaattgagccaagattgtgccattgcattccagcctgggcaacaagagcaaaactccgcctcaaaaaaaaaaaaaaaaaaaaaaaaaagcttgttgcttcaaattcatgtcagtctgtaaaattatctgggaaggcagtacaaaaactgtcactttgactacgatgtttctggtgacccatcttcattgatcagtatggaaaaggcatgtctctgaaaatctctgagagtctttgatacagcaagaacataaggataaatcattcttctatgttcatggttgtagaggatcttgaatgtttaatggcagaatagccagatcacactctggcacttctgtatgagaggctgagggatgttactgattcaccccgagaaatatttactactaaggggacagaggcaaaggggatacaagacttcaccctgagctgtagcgctccctccttccctatcctgctttcattcttcacattgttttccttctttcttttttattattatactttaagttctgggatacacgtgcagaatgtacaggtttgttacataggtatacatttgccacggtggtttgctgcacccatcaacccgtcatctaggttttaagccccacatgcattaggtatttgtcctaatgctctccctcaccttttccctgtgtccacattgttttctttctttttgaagcctctcattcactaggtttcaatcctgccttgctagtgttctaactctaaggcctaggcaagttatttcaccgaacttagcctcagtgtcctcatctgcaaaatggatagttttatgatatcttcagcccttaaagtcaatggttctgacagctagggtgtactatcttcttggatatcagtcatctcaagcaagccctccttttttggaccttcttttcacacacttcacataccttagagaacataatacacatcctctttactcagggcttattctttataacaggcttcctaattcaattaactcaacttttcaaaaatattagtgactactgtgatgtaaataaatttgcattttataggggtcttagtaacccagaagggagtggggaaaattaatatatattgagagtttattaagtgctaggtactgtaaatattttcttgtatttaatcctccgagtaattctacaacaaagatattatcattgctattatgtaaataaaagaacaaagtagaaagaaacccacggtcttgtataagctcccctagttggtgggtattgaagggagtatttcaatctttggtagcttctgagtttttgttctctcagggaatctgccagatgtccagggcacctgccaaaccctatgaggctataagaaaaccattaagggtcttagattacccagctttttgggagttagaattctgaatgaaatttagtgttcctgcagctacaaaggaattgagttagggaagtgatgactttatctttagctacattggttattttccttataataatcctggcttggtagattagaggcagcccgagtaacccagaatcgctaaaatagaagtgcgagctcattgcccgctgtccttcactatgtttgcatataggaagcaagaataaaacaagcataaaataggctaactagcttgtcagagctcttcacaccaagtctttgtgagttccaataagacactgactattattaaaaagacagagactccacataagtaggaatttattgttttccttttcagtcaccaaaggacaatcctctgcataggttagcaaaaaatggtactgatcctataatctctaatattaaagtttagatttggcaagctgtacatcttatgttgttcattaacaaaaaacaatattgattggtatcttgtactataacttgtactgtgggtcaaattccaatacagcaaataccattgcaataacaattctacaaaactacatcaaaaaaacctttcatgtttgagccaacagcctgatagtgctaaggactttgagtacagtatgctagaagattcttaacagttatttgtcctggacaacaaaggttgactccattaaaaacatagccatcagtgtgggattatttccaaatcaagcttttggaaaagtcaaatgaaagtttgcaagcaggtggggcatggtggttcatgcctgtaatctcagcactttgggatgctgaggcaggcggatcacctgaggtcaggagttcgagaccagcctggccaacgtggtaaaacccccatctctactaaaaatacaaaaattagctggcttttgtggtgcatgcttgtaatcccagctactcaggagcctgaggcacgagaatcacttgaactcgggaggcagaggttgcagtgagccgggatcatgccactgcactccagcccacatgacagagtgagaccctgtcttcaaaaaagcaaaaaacaaacacgcaaacaaaaaaaaaaaaaaccaaagttggaatgcaataaatgttcattgaatgaatactgaatagggagtttcagctaatccactcaaaatagtgctgaatttccagctctaaggtcaatgcttggcatatatatcctgaaggaatgaatggacacagagtaattttttttctaaaatgcaaattcaattatgtcacttcccttcttaaaatccttcagtagcttcccgtagcctccagcatattattttgaatagtgcttctcaaactttgatgtgcatcagaatcacctggggattttcttaattaactgatgctgattcagtaggtctggggtattgtctgagattctgcatttctagcaagtgctcagggttatagcaatgattttggcctgcagaccatactttgggtagcaaagacataagccacttaacttgacataaaagactgtttagacccttagtttctctctcgctctttccccattttgagcttttgctccggttcatgtttttccctgaaaataccgtgatcttacattgtctgtctggatgctgaattttccctaattctgggcctccatgtagttttaggtttgacatcacaaccaccaaaagatttccccttctcccttaatcttggttaatgtcactctcatgtattatactgttaatgaagcattgaggacataaaacttatcaaatattttatcacaatcaatgatggcaccagtgataacatccaaatgcctgggtgagtaaataagaggagaataggggacttgttgttaaactaagtttgcagagaaaaaatgtactgattataattaaattggatgtttatttgttatgacaaaaaaggagctagagtcttttaatccaccccttggcaccactgcttatctccttgtaacatacgtttgattcccatgtctatttcttccatatgggaaatttcagctccctaaacatcaccaatacaacctgttgataagacaaagttaaatttattgcttactatggtaagaaagaccacagcctggacaaagctttggtagtatttcataaggagaaaggtgaggttggatttcattgggagtatgaagcttggtttaagattggtctttcactgtgggggcacaattaggattgggtaaggatcatggtattacaacttagtttggtggaaacagcacagtgaagatttctagccaagaggctcagagactattaaggtgtgaactctattgatgttttttgttgaagagttgatgggagtttggggaagttactttagtgaacagtcaaattatttgcctggccaagagttatctgtaataggaaagttatgctaatgaagacaatggaaaggtaaaccatgttaatgtcgacagccagctatgtgagcataaggggtaggtagctttggtcctccatgtccaaactgtttgtagtggtaagtgatcttcattctcacatagattgaaagcttcctgaggacagggcaatgtctttgtaaactttaaaatatctatgtcctgcacatcacctgccgtagacaagcatctagtaattgacggttgggtagatactgagggaaaacatgcaccaaataaaaatggcaataggacacaaattcactatcatttggaagaataacagtgttttccactgatatttgctacacacagtggggtccacagagcagcagtaccacttgggagcttattggaaatggagactctcaggcaccaccgcaggtccaatgaattaaactctgctttttttaaggtcatttgtattcaattattatttttttcttttttctttactttcgatgcatttttctttatttgtttttgagatggggtcttgctattttgccgagtctggtcacaaactcctgagctcaaatgatcctcccacctcagcctcctaagtagctgggatcacagatgtgagccaccacacctggcttgtatcacattaaattttgaggagcagtgctttaatatctattccattctcatcacttgatgaggtattattaattccacttatggatgtggaagttgaagccagaaagtttaaatgacttgtacaaggtcaaacagcttacaggtagttgagccaagaggctctcaagtcttctgcctccacaaacccctgttcagctgctgccctacaatggaataaaatatactaatcccagagggacaaatatgctaaaaatctcaatattatacactttggaaggtgcaggtgcattatctttcaattctaatttctctttcaagttttctgatgcataaaaatatgaacagcaggtctgagcaatgtttagatgccgtgctttgatccttttgccattcaagatgtttgatttgcattctgccaaggaatgtctggtaacctccatgatgcagaccacaccattagtcaagagagagctgacgtaccttcatctgagagctggctggctgtgagctgctcagagggaaaggatttctatttacaaattgtatcgattatttataaataaaagttccccttgctttcttcagttgtaaaatctgcagttagagagtcgggaagaagatcaaaactgcatacatttgcatctgccaagcctgataactagttccagaattacagaaatggtgctgaaatagcacctcaagtaccaggctctatcaaatttaatctatccataaggcaactgccaattatattttagagaaaaaatgtagactgaaaagatagacaatccaagtagcaactcctgtaaaattatatgcccataggagcaatcttgaagatataaatattggtatgtttctccttcatttatcatttatctgatcatttgacaagtatttattgaatgcctgttaagggtgtagatatatgtggtgaggctgcaggtgtaagtaggtctttctgaggatatgcatgaagttgatgttcataacttggagatgtgtgtatacagactgaggattccttcagtggatattaagaagtggagtaataggcagtaaagaatacactagtcagttgtggtacataaacacgtcagcaccacttaggtattaacttcctgttttgttttgtgtgtgcttaattacgctgtttattaaacaagcacatcataatctgcagatattgtcataaacagcacaataaagcctgccacatcagaatgtcatctatcaaattaggtgtgttcctcagctgtcccgataggcacacacctgtgcctgtaaataggcgcttggcggagattgcttccaggtgtggatctgttgggcgaccttgggatgtagggcactttggaaccttttcctctagcttcaggaattaacctctgggcttggttccatgccagcttgcattttgctttgggacagtaacatgtaaagaatatgcctgtgaatttagggttactgagaagtcctcatagaagaagtaaaatttccttgaggaatgggagtcttttattcaatccaggtttaatgcaaggcttggtgaacagctccagaaggttaataattgcgtgcgtgtgtgtgtgtgtgtgtgtgtgtgtgtgtgtgtgtatccttttgtcattcaaaagtatacgtatacacacacacctgtacagctgatgataaatatacattgtatcaatgagttcaaatgaagtgtgctattcattcactgaggaatgggctattataatgaactattatgatattagaaattgtcagggcaataagcaaataatacatacggttttcaacaaactttctaagtattgttatcagtgggtttgcttaaatctttttttacaaatttatttatttttttgagacgaagtctcgctctgtcgccaggctggagtgcagtggtgcaatctcggctcactgcaaccactgcctcccgggttcaaaagattctcctacctcagcctcccgagtagctgagattacaggtgtgcgtcaccatgcccatctaatttttgtatttttagtagagacgggttttcaccatgttggccaggacagtctcgatctcttgaccttgtgatccatctgcctcagcctcccaaagtgctgggtttacaggcgtgagccaccgtgcccaggcaatagccccattgctcagtgaatgaatagcacactttattttaactcattgatataatgtatatttatcatcagctatacaggtgtgtgtgtgtgtgtgtgtgtgtgtgtgtgtgtgtgtgtgtgttgaatgacaaaaggatacacacacacactcttattaaccctctggagctgttcagcaaaccttgcattttttactttcattacagtgtgtaaataatttagcaaattctaatttgaacctgatatcaattgagcatttaatatttagccaaatatttatcaagtgctgactgtgttctagatgctggggctgcaatttcgaaacagaccattgaggccctcatggagctcacaataaatgatcttccttaaagtatcaggtctctggtttgttaccgtattttttaaattgttaaggaaagaaaaaggccctatctttttgtagacaaacatgccctaagtgcttccagaaataatctccatcaggtaatgcagactgtgtgtggagtgaaattgagtccaatccatgatccagcagagtttcagcccaggatttctttagagcctttgctacacacaaagttggctgatgtgccattcagcatcccagcagctctttctcttcacactagcaatggcaaagctttgtgcggaggcattgctggctgctctgaactaaaagcatccgtggggaccgaaagaggtttttgcacaccttattaaggtaggcaagtgtgtctgagtgtgtgtgtgcctaaaagctggaagacatctgttgagaggaaagtgctcttctgtgggtctggcagcttttctgtaagtcttctattctgatgcaggagcgtgtgagcagtgggtgggaggagatgctttggtacttggaatgctgaggtccggattaagtggtattgtaatagctagttagaggcagaataaaaagctgggaatcaaagcatttaaaaatgcatccttccattatttgctctcaagttaaaccatattcattctaggggaaattaaaaaaaaaaaaaaaacacagcaagggcaagtagcccaaatctgtaaggtctttgagcttctctgttcgtccagcttttgaagtcttcctacagccaatttgtttggctcctctggagggggcaattcatatccacttccctctcctggagcatttctttcttctatactccatcagggaacaatagagtttaacagtaacaggcaattttttttttttttcaaagcttgtgccctcttctgcgtttaaaggtgttttttaagagactcctgctaggggaatcttggcgcctgtgtgttaagacggcaattaacttttagtatcagtgcttacattaaattttctctctttctgctttactaaagcagtcattaaaattcagtgtgagtaccatgaaactttatcataaaaccctgctttgcttagagaaccttgattgttttctgaaagcagccttctcagtttatatatacatagctgccttccttggaatatcaaattgctttgtgtcacattaagaaacactaggttgaacctctatactgtgttttatctgagaaaaatactactgcaaaaagtttgatttgttcaagttttaggatgaaaatttctttgtaacaagttatttgagttgcatactatgtcatcgtatatctctttagttcaagtaattttgcaattaacatacggttatgtaaagaagataatgatttattttttatttatatttttaaaagttattaagtgaggttttcctttcagtaagagtttagaaaaaatagccagaacaagtaactggacttggaagataaagatacctttgcacttctaaattttacctttgtacacttcggttgtgatttaatcattgaaatgcctctgctttgaagtaaatgcatcacttatggtgtatgctgtgttttaataaagggaaaacagttatgggttctctgttgcacatttgaatgttgttattttttgctgtatttaataacctcttttttctcttgtgaggtttactttggaaatgaggcatgttcaaaaataggctgacattcagcttctatgttttaaatttaaatgctgtctgtgttttatcacatctggaatgtgtggggagaaaagataccaagttttattatttagatttaattgtagaattgcagattgatatttttcaatgcattttcattatagtttctgccatggaggcagcgtgagggctttcaggaagatggagtggtgtaattaccaggtgcgcacgttcattaatccttcctggctagagaaagcttcaagttcttctccagtggcccattcgtaaagctataaatatctaaattgtgtcagccaagaagtcacacagaatggtggctctttttgagttcaatttcatgcactgttgctttggtcttgtgaggaaagctctgaattccttaggatagtcttggttgtgaagttccaaaaacaaaatatcaaatcattaaggatttaatttaaaatacatactcttctttcacaaactagatgattgcagtaatgtggattataaatttttttttttgctttatttctttagagctcctctttttattttgtatgatcaagattatagctgagattttggtgatttttttaaaaagatttatggcttatggtccatcagtctctccactacttcaaacctgtgtacccctgtatattatctgcagtactggaatgtttgcattgtatgtggaagctatatacgatttggtaaaaaataacacttaaaggtcttcgctaagagtgcttatttaatcattaaatatcccttaataaaaataattccagagatattgtctgtgtacaaacttaaaaaaagagaaatataaaatactgtgatgtgaataaaatgtatagcaatacactccaataataccattcttatgttttcccttgttctcaactgaaataactaagctaatagagacgtcagtaaggaatgtgttgtttcttcataatacaactacaaactcatctgataagaacaacctgagagtgaacgttaactttcctcattagaaagattcaatttaacacatatatacaaatacatttttaagataatgatatttgcagagtttttgtattctatggagtaaaggagaattatcacatattcaaagtaaaggtataaaatacatcttaatgttttacttaaattttaaagggtccaaaatatactaaaattgtttttctaattctttcctatgtttaaacgtgccagagtcattggaaataggacattctttttcttaagaagattttgcccaaaatatttaaaactattttcttttcccttgattttacaatttcaatattcatggatttttctactttaaaaataacagtagtttttatgatcttaaaacaaatgtttaagggcactttcgctctctggagactataccatccacatatttattatcagcaaaagaaagggcagggcatacttttatttgaagttgagtataaaaatgtgtctgtgtgtgagtgttattaaaaagataagtgaagagacaaatatagaatccaggaacattttcagcctggcttttactctctctaaaaatctaatgaaacccttgagcatctcttatctcaaggtacattaggaactgtccaacactatgatccgatgggagatcagtatattcatataaagaagaaaatttgttgttagtgaaagtcaagtcttttaaaaaaataatagttacagcatttgcaatatacaagcataatagatttactcaacgcccaccccccatctttaaaaaatcaatttccgacagttgtctactttaaaattgaacatatttgctacctggagggaacattgtaatgtagcccatatgtggtatgcatcctgaagaaaacctgaaattatagaggaagttatcctgccttctttcttctgttgaatgagttaaaatatattaacaatttgcctttcactttgtatttatcattttgtatctttgcatatttacatatacattcatgtgtacaagggcatatatactcacaggtcagggctatttaaacagctatttatttgaatatgccagggaaaatctccaagatataaagaagcagttattagatactatgtcagtatagaattaacagccatcttttttaagatggaagagaaaattaattaattacatacaatttctaacctcaagacattttctttctggagacaaggaatactgaggtgctcacgatagtgaagactcaacaagaccctaataaaatagatgaggataagtaaaactacaatagccaataaaaaacaaaaaacaataaaccatgtttcgctggcatgttggtgagtatctctgtaatatctgtcaataagggtctctgtagatttggagtaatgttcaggaactacctgtactagagaagacagtggagaggactccagtggctaaattctgctgcctttgcttccagaaatgtaaataataaggaggtattgtggcatttcctggaagcagtagtcttgtttcatggtctgactgtataagaatgcctagagaaacataacctcagctgactaaactcccttgatgattgtcactttgtcactgaactctgaccataccttttgcctccagaggcaaaagacgggtgaggaagtgatctcctcatctggtttttaaacaagtatataactagagaactggattatctcctaaacccactcttgtccctggaaaaaggggagtcatcctatccgtttcttagccaatttatgtatactcttagtttgagagcatgagaaggaaaactattttcttttcttaccttggctgggtttttaagaatttatttttagtttaatcaaaataatattttaaaaggtagtaagcctctcataagcagtttgatctgttctaaaataacttcaatttttctttttttaaactttcttttatcttacacacaaagtataatagtaatatgtactcactagaacaaatgaaacaggatggagtcacatagagaaatatatcatattctccctatcccctcccttaatattaacatttaggtgtcatgtgcttctccattaattttcattgcaaaggcctaaattttcttccaagagtgaggagtagcagcacggtagtttggacctgatatagctctctttccctagccttttgcttaagtgctttcctaggggctgactttacttacctaaagatgtttcaagcaagggctcacatttttggtagcagaagacacttactgattgctctcactaataattttgaaaggaatgtcaaaatctgggaggatcatgaaagaaatatcagaaatttcctttcagctgccattctccttaatactgttatcaataaattcagcatctcatatgtgatagcaaaaaaggtgctgccttttgttcttgcatcctgaggttcttacctaataccatggtagcaataaagatggtgagaaaattgcttcttctatggtgttcaggtcctgaacgagcaccctcacctccacagacggtggcaggtattcaagcattttacagactttggagttaaatatagcagtgttattctaatttaggtatgccaccaccagcggcaccggcaactgcaataggaaaaatgattggcaatgccagctatctgatgttttcatgtgccaggtgctgtcagttcttcacagtattacattccatcctcacaacaagagagtgccagtgagtgttgctgtgtgccagtgcccaggctaagggctttgaacacattaccctgttttatcctcataactttccacgttatttttattcctgaatgaagaaacaagttctctgtagagatgctgtcattgatccactcatatcctttcacatccgtttaacattttccctgctgtgcttttactcccaacaactagctccctaatcgctctgttggagggtggccttgaggctgccagagcctatttggtctgtgtaaagagagagatggatctatcctggaatttatgtccctgtgtgtgggaagcccttaatcaatgactgctggttgcagacacataaatacgtgagctttcttgttcccaactgagaaattcagaagtgtgaatggcactgccaccctgggcttttatgccatatatgtgtttggtctgtttcccttcccaatctcacttcattttcccttaccagtgtttcttgaaaacacatcccattagatcatttttgcatgaagcttcatctcagaacctccatttagggaacccaaactaagatattctctaaaatagaaactttattgataaagtttccaaactgtcttagtagatggccaatataagaccaagccaaatctttctgggtccaaattccctgtctttaattaatagactccattacaacacattcttcaatctttagtcagcaaacacttaccacgtgcctattttatggcatattatatttataccatagttaggatattatggttcatgaatattttatatctgtacacctgaaattctattgacctctctgggccacagttttgcatctgtaaaatcagcacaataatgctacttatctcatagagtagacttaaaaacgaatgaaatgatatatgccaagtgttgagaatcacaattggcaattactcatgctcattaaatattagctgtttttatgagtattgtttcattttcggtgcataatatcctatgcaaagaacaaaaggtattggtataggcattgaaacttgaagcatagaagaaaaagttaattaaccggtgccccactagatgcctctaactgctggctccgtgtatccctttagccttggctcgtcacgagaaaaccttggagacatttctgctggactcagcagatcaatttaagaaagatgaatgacatttttcttgaaatgtattcagtcatagctgcctttttctactttcatattttggagttcttagaaaaaattaaggactcctttttttaaagaaaatggtataaaagaaaatgcatatcactttgtcactttattattgtaacctcatcaaagtattcagtgtaaagacagtagccaagtgaactcttcttgtaatgctcggaaaccattttagcaatggtaaaattgctgcaatttatattcgtcaaattgcatgatttgacttattttagaaaagttattaacttctgaagagaatgcttcagaagcatttaaatgagtacaagttatcaccagtgatatacataaatttcatttcaaaatatacttctagaaactgtacttagttagctatagtatttgtacaaggattaattcctatttcattttgtaggaatttatttatgaatgtctatggcctgccagtgtaaagcagacttagagcatcatcttttacaataatctttttttttttaatcaaaggggagatattctggtaaaacaaaacaaaacaaaaacaatagtttattctgcatttttattaagtccctctgtaagtcatccctgaaatgggatatgtagagtcttatatttatttatttctcagaagcttattggaggtgatatgaaggattttaagaccctactaactaacaaaacaacaatttaaaattaattttcaaaataccttaacaaatcttattctccttattttcaaattctttaacaatgtttttcttattactaacataatatcttctgatgtagtcataataatatctaaaatgacaggtctaagtaacttacatggattaattgagtcttctaaatagtaaggtagatggcactattacttctatatgagaaatgaggaagtagaggtataaataagaaattttttggccgggtgcggtggctcacgcctgtaatcccagcactttgggaggccgaggcgggctgatcacgaggtcaggagatcgagaccatcctggcgaacacggtgaaaccccgtctctactaaaaatataaaaaattagcctggcgtggtagtgggtgcctgtagtcccagctactcgggaggctgaggcaggagaatggcgtgaacccgggaggtggaggttgcagtgagccgagatcgcgccactgcactccagcctgggtgacagagcgagactccatctcaaaaaaaaaaaaaaaaaagaagaaatttttttgagtgtatacagttagaaaatggcaaaatgggaattcagacccaaacagtaagactcaaggatacctttcttatcagtatgctaatatgaaaacctaagcatactagaaaatctaagtgccagttggaaaccagaattaacattttggtgtgtaactttctggctgctttttctatgctaacaaacatatatgacatacaaaaatacacacatacacaaattcctgttcactacttcttttatgttaacatcacaatgtaccgtacacagctgtattattttatatttgatttcatattttttctaaagtcagtgtatttgtcaaatatcaacttatctatttaataggaatatgggatgatctttgcttatacatacatacatatgtatataaaaacaaaatcaagtattttaagcgttcaccagaagtcatatgtcaatcagtaaagtatataattttttgctgccaatgacatatatcataaaaacgctacctatcatagaatgaaaatgaaacacagcaatattgggacacctattctcaagcaacagctttgtgatttattagctatctcacatgaaataactcattaacttggtattccaagcagcaaaagaaggatcacttaggtcacttgcaaaataatacaaagctaggtttaggggtgggttgcgcttggtgggatgtagatgaaaccatatgggcccttgagtttataattgctgggatctgcatggtgggtatatggatgtttattacagtatgctagtgagttaagaaagaagaggaattattattgacttacatcatagagtttatgcaaaaattaaacgataatttatttttaaactctagaggtataggtaccatcatgaagggacccacagaactgatgtagccagtaattattggagctggaacagatactctgctgtcagttgttctggttttgtggtcattgttcttgcctttgcaagttaccaactctaagaccttgggcaatactttaagtcttggttgtctcatctgtaaaatggggagagcagtaagtgtcttaaaggtttattctcatgttatatgacttacggtatgtaaaacatctgcgtttagacacatagagggtgcttaatggatgattgctctcattattaggctacatctaatctatgaatttaaaaactgtatagaaatatgtgacagattctttaagagccaaataccaactacagtgaaaaatacttaacacttgctgagctcttagtatgtgtcaggcttaactaccttaatgctcatagcaatcctataagataggtactcttgttatcctattttatatcttctaaaattgaagcaagggaagttaaataataggacaaagatcatacgctatctatccatatatacccatctggctgtctacctgtctccttccatccatccatccacttattcatctacccatccatccactcagttacttctctctctcccaccatccctttccctttccctctccctctccctgtctctgtcactctcctttacttatctatctatcgatggatcggtttatctatcatctatctatctctatcatctatgtatagttgttaataacactaacattttataaattacaagactgaaaaatgttttcattaacttatggtaacaaaagaccacattgtgaataaaaaaagcagtaaacacaggtctctgcacatatgaaagagatgtcctaaacaggaagagatgtcctaaacagtagggatacatagtatcatacaatcaaaacatggcagccctataaaacttacaaagcaatttcatgtaagttatttcatttgactcttaccacaatctatgaggttactatttttatttttctcattttacaggttaaatttaatatggcttccaataaaaaattagtatggttaataaatatcttgacgtcttgctcctataatcctaccgatagtttacagtaattagtaaaataaaataataggaaaaatacctttgatactagtattaaattataatcatatcattaggtaatttcaatttgtgattttcaagaatctgtaatatggtagcttcttcctactgacatgtttgaattcattttaaggcttataattcacaagtaatctatatattatctaaaatgtaaatgcacattcacatggagataataaattagcgtgaaatggctgtattttgctctctataatttttaacatacaggaaatcactgttgtctcaaaaatcaaggaaatatagtatttgaggtgaacttattctttctactattaacacattttaatatagttctctcacagtgcaacagagcaagaagctttcagacacatttgctgctgcaaggagcatgctgtgctgaacttaaaacaccttccctttcaaactccttgggactgtttttttccaagagacttcaaatgcactaaatttagcatccgttggaggcacacccaggcatattatagtgaaagccccaataactgaatgtgttaccactattcacaatgtttatgtgtgtatatgccttatctatgatgtattgcaaattacaaaaattgtgttattattcacagtaacaaaaacacttccagcaaatttctaacagtgatctcttttgaaataacttacatacatgtgtcatgggtcttaaactttgtcacttttatgtttccatcatgttgttttagccagtgagggttttgtttggttttcatttatgattatatactttcaaaaaatagatttcaaagtgtgaatttgattgattgattgactgattcattgagacggtgtttcactcttgttgcccaggctggggtgcaatggtgcgatctcggctcaccacaacctctaccacccaggttcaagcgattctcctgcctcagcctccctagtagctgggattacagatgtgcaccaccacgcctggctaattttttgtatttttagtagagacaggggttcaccatgttggccaggctggtctcgaactcctgacctcaggtgatccaccctcctcagcttcccaaagcactggaattccagacgtgagccaccgcgcccagcccgtgaattttatttttgaaagacaagaatgtccttgcctaattgcataatagtttaacatcatgaagactaaatatgctttttagccatgacaattttatttattattgttttcatttttaattttctcaaagatcctcatcagtgtactctttttggtcttccttataagcgtattttaacaggacataataataagataaatcccaactttttaaagttgtatccgtatgtattactttaaagtgctattaatataaacgaattagaggcaacttttattcaatcagattttaagtaattttaccaaaaatatggccttgataatgtctctgtaacaggttctctgtaatatacatgctgaggattggtttgtctttgcttttgatactattttaattagaaaagtaatggggaatccagacccttctcatttaataatccagagaaaaatcagtccatgttctaatagtttaaatttttctactaaaacccatgtgagaatccatatgagtggaatggagaggagttcagcttcaaagttggcagatttgagatgattctatggcaacagaaatgtgcttgagggaaatcagttgcggcatcttctataattgtgtcacctagattttgccttaggaatttctagatttccatagaacattgtgacctcaaatgctttatcttaataaagaaataaaagcagattagaagaattatttgcctacagtttgtgggagatgggcaagtcttaagagtttattaggtacccagaacgaaacatattttcttgggcctcataatcacattgaaatacaaggatttagttatacacagtgaccagttagtgaatgacagtcttcagtatctagtagacagtaaacatataaagatgtatttgtggccgggcacggtggctcacgcctgtaatcccagcactttgggaggccgaggcgggcggatcacgaggtcaggagaccgagaccatcctggctaacacggtgaaacctcgtctctactaaaaaatacaaaaaaaaaaaaattagccatgcgtggtggcgggcgcctgtggtcccagctactcgggaggttaaggcaggagaatggcgtgaacccgggaggcggagcttgcagtgagcagaggtcaggccactgcactccagcctgggcgacagagggagactccatctcaaaaagaaaaaaaaaaaaaatgtatttttacttttaactacagcgagagaccctggcagcctacagcatacaattagtgttcattatttagattgcatggatttaatgtgaggggtcaattacttgtctaaccagtgagcctagcctcttgctcaatactgcctgcttcatgagggtgaactgtgctggagaaatatattacaggattatctgcagattttttttaaatgagtggttaagtcaaaagttcttgtgaaaattcagagtaataaattattatgaagttgtgtaactaggtaaaggatagtttcttttacacgggtaaagattaacatgaggaggaaaactttagcaatggcatttaattccattcaatatatttatattgagctcctttaaaaatacagggccttgtggtgggtgctgaggacagaacaaaaaccaagtaatacatgaacataacccttgatttcatgatctagtagacctataaaagttgtcgatatctgatgaaaagaaaatggtaaagatattccaaacagtgtatgcaaatccagagataggatggaggggctctacctgaaggatgatgataagaaaaccgtgttgagtgaagggtgatttgtggaattcagataaaatatcagtcttgaatgctgagtgaatactcaatgattgactagatcccatggacagtaatttcttcaattatgacgatgctagtgtttatgactataactatcattctccatgccaggcactttgccatttggtaaatgtatagtgtgctattctaacaagcatgcacagagcttttactttaatgtatccatgagtttattggggttcagaatttaggtaagctttgcaaggtcgtagcatggagtaaaatatctgaaattcagacccatatctaactaagttcaaagactgtacagatatttctcctcctttgtgcagagaaggataggaatggttccatattatcatggacttagtcagatgttttaaaattataatgtcctgtgttaatgaagaagggatgatattcagtgcatattcttaaccgttactttgcttaatgctctcgacttttctgtgagatggatagtgtagataaaatccccaaggggactcagcaagtgcaagtaaaacaatgaaactttaaagccctttgtcaaaacctctctttttctcagaggatggaagggccgtaaaggttggtgaggaaggatggaccatttcctatgtagtcttctgacaatattcaaacaaaaggagagtcagcaaatcccccttgatgtgggaagttttaatacaatttgcagagtgtctctctggagtagacatcctcctctgcaatcgtgtcttctatatagcctcagggctttgggtaggtaatcctctccaaggagagtcctggagagggctgtctaccccccttgcaccatcctctaacattattctatagctcagctccttgtttctgtttcctgccttgtttttgtctgagtctgcaattatgatgtaagcaccatgaaggaaggtatgttgccagtgtttgcatcagcatatcccccgtgtgtagcagcgcaagggatatagtgagccctcaatgtctatttgtagaaaaaagaatgaacgtatcaacgaaatctgatacatattcattgtgtctgttatctccatctctcttgtcctgccttgttatcttgccattttcacaaaaggccccaaggcccatcatttcttgtgtaacttccagagtgttaatttttaaattaaaattaaggctttctacatgagtgtctattatttgagaaaccatgcaagatcgtgtgtgtgtgtgtgtgtgtgtgtgtgtgtgtgtgtgtgtgtgtgttgcactctatattatattgaattctggattttttcttataaataaaattttaaaaatagttctttaaaaataggaataagatgttttaggaggcacagagagcaaaggagaataaaaattgcaggtttggggttgtgcatactaattgccattgagtaaagagagcacactgaggccatttagaagagaattaacgtgttttgtttttgtttttgtttttgtttttgtttttgtttttgttttgagacggagtctcgctctgtcacccaggctgaagtgcagtggtatgatctcggctcactgcaacctccacctcccgggttcaagtgattcttgtgcctcggcctcccaagcagctgggattagaggcgcccacaaccacgccaggctatttgttttttttttttgtatttttagtagagacggggtttcaccatgttggccaggctggtctcgaactcctagcctcaagtcatccacccgactcagcctcccaaagtgttgggattataggtgtgatccactgcacctgaccttatttttattcatttaaaaatattaaatgttactgcatagggagtaatgggcttaacaatgaggtgaccaaaactcctatgtaccatgcagagcaatgtatcaaatgtttttaactataaacttctcaaaaacataaacctaattgttctgcagctgcaggttatatctgccttgtttgagcaaaatttggtggtgaaaatgccttgcttccatttttccttcaataactgatatggtttggctgtgtccccacccaaatctcatcttgaattctactcccataattcctacttgttgtgggagggatccagtgggaggtcatttgaatcatgggggcggtttcccccatactgttctcatggtactgaataagtctcacgagatctgttggttttatcaggggtttctgctcttgcgtctccacattttctcttctgcttccatgtaagaagtgcctttcacctcccaccatgattctgaggcctccccagtcatgtggaactataagttcaattaaactactttttcttcccagtctcaagtatgtctttatcacagcatgaaaacggactaatacaataacctatataattttgaaaagtacttgtctaatagactttcacaatagaaactatatccttatcaactttgaaaagtcattgcttaatgcctttggataactgaattttctaagattattttaattttgaaagttaaattttatcccagtgttgacgatttttgtatgctacttttaaaatattttgtcagtgatttatatctatggtgcaatcttgtaaaaaattaacaatgcaaatgtggctagaccatttaaaaatcaatatgttataattcagcccatttaatcactttagttaaacatcttaggaacaactcagttccatttgagagaagacacagttttctagatgtgtgttgtggcatcatattgctttacaatatcttacataaggtgaattcaaatcatatcattgaatctgttttaaattctgtcatagcttaagattagtgactaaatattggcaggtttatggaagtaggatgtaaacaagacaaaaacaagggtggaacaagtaattttagtatattattcacttgcacagagaaaagtcattcacaccttcttcagctttgtgaagaaaatagactaaaatcctgttgatatagcaactatgttttccgtttcttgtataaaaataaagaaaacttcctattaggaattagccagacattttaattttctctcttctttctctattttcccttacagtctctttgaaggcaggcaaaatttctataaagttttaagaatgttttaagatttttttattgtgaaatattcatagactcacaaggagttgcaaaaacagtacagagatttcctgtgtatacataacccaactttccccagttacatattaaccaaatacagtatattaccaaacccaataaactgacattggcacagtgcaatcaactagactgtagaccttacttggatttcacctgtttttgcacatgctcttttactgtgagtcattatctgttattctatgacattaaccatgtctatagatttatatagttactaccactatcaagataaagaagtgtttcatcaccacaaagtaacttaaaggattatttttataaagtaatgacaaatgtgtcaaaagccattcctgtgttatatagcaagtatgttttgagttattaaaactcactgatcatgtctttcagtgtcataactttgggtttccctccctaactataataatcctgatgaattacagttgatgaatatgagaatatccaactcttcctgactctataaatatattgactgagattgtaatatttatggtgtcttaaggggcgcttgttttattatgatgatgtgaacatgttgagaatagtaagaacagcccagtttagcaaacaggatatgagtcttctatatccagctcaatcgttgccccaacaggggacatctgcctttgctacttaattttccattctggaaaatgtgaagtgtatgagaatgaataatcgtctccgattttccagcacataataatctgaggagagcaggtacagcaatttaggagctgttttcttttggtttccaaaaaaagttccgtccagtggtctaagttagtcgtttactaagtgatagagcaattggctatgctttttgaacggactgataattatgtggatgcagcaaataggatatagacaatgcatctactccattacagtaaaaaagactctgatagcagttaatccacataccaggcacttagcttaggcacagttggaggaaatggaatggtaatagactgtagtatggcatgacaggagctgtagcttgagattcagaattccaactctgcctctcaatatttgagtcctcatggccaagatatgtaaagtgctctgtgcaggtcttggcaaccatccaccacacacttagtatgcaatatctatctttattagtcaaggatctggaaagctagttgatgagacaaatgatagaaacaagagttcattagatgaaataaagtaataaatgatgcaagaatttaaaaaagatttagagaaggaaagggaacagaactcacatgcaagtagagcaactgtgtatcagataatgtgctagctgagttagaaaccatgtctcatattaccctgaaaataattctgcaaagctgtaggtgttatttttttcatttgacaggtgaattcatgaaggcttgaatatagggttaagtgagttgtttcaatgtagttattgattcaaatcaagatctgaatgactctaaatatggtgctatagagatttgaagtaggataaataggatttgaaaaaaagaaaaaatatatagggaaaggaattggtacactgtagcagtgtcataaatgaagcttcagttgtgtgattccagatgatgtatgtgaggcctaatcaaacagctttgtggaatcaaaatttctgctcttgtctccaactggggacgagttggctcgggattaaggtgggcgaccttgggaagactagagtctaagcaggactttagtccctcataagaattatatgaggatgtatatttgcatacaaattcctgggcccaccgagatctgccaaattggaatgtgtggtgatatcacccagggaaacatagagagctgttataattagtcatgaaatatttagtactgaaattatagattatgttaaataatcacttataggggacatagcagggttggcaggttaaccatacagcaaacagggttgtaagtcagggcctagagaattttcaagaggcaggaattctgcagaatgaaggcctggtctcatgcagcaccatggacagctccgaggcactcttgtttctccaaaaacctgaaatcaaaaactttgcttttcatcatgcaacatacccatgtaacaatcctgcataggtactccctagtccaaaattaaagttgaaaaaaaaaactatactttcatttgaatacagttctcttcggctttaccagctctactctggaaggaatatcttttactcaatgaaaggccatcccctgttaatgcctggccaggttctccttatcagtcattcactatctttgtgtgtgagtgactaaacatataatgctatgtttagtggatggagtaagattacctttgcagaggttgtactggcttacccctttggttcttgtagttttcttctattagagttttttccatccctaggtttctatactgttcaaatgggtttaagattcttgaaggtattcctctgaccttgtaatttatgcttgtctcctagcacaacttttttttgtaaaggaggcaccaactatgtggtttgctggcgatggcatacacaaatcaggtgggaggaattaatgagagcagcaattccaatatctggttcttcaagattaacttgtatagtttaattcagcattctaaataagcctcatagatttaaaaatctagaataaacccacatttttaaaaaaagttttatgttatctgtgctgataatgcacgctgtacataataaaatattattttcttttttttaaatttattattatactttaagttttagggcacatgtgcacaatgtgcaggttagttacatatgtatacatgtgccatgctggtgcgctgcacccactaactcgtcatctagcttaaggtaaatctcccaatgctatccctcccccttccccccaccccacagcagtccccagagtgtgatattccccttcctgtgtccatgtgttctcattgttcaattcccaatattattttctaagtggcagtggaagaaacatggaaagttctacttcatccatcggtggattagaatttgtataccatgagatgattaattttcaaaaccagtttgaatctcacaaaataatgaccctgttttttgaaggacaaggcagaacaaggaactaggctgtgccacgttcaagtcacaatctctaacatttgttttgttttgttttgttttgttttgttttgttttgttttgtttaatctctgttgcttgttcactttctcttgtaatctgcattgatttgctacctggctatttgtagattgacttcggctgccaggaatggaatgtttttcataaaggaacatatgccttaatgaaagtaccataagaagggagtagagtgtgaccaattgcctaggtaataagtagtgacaacaatgatattattctagtataaatggaatcagtttttctttgcccagggggcatgataaagaaggcctggctggtatatactaggtgggacacaccaacagtgcctagaatgtcaatggatcaaacctgagggaaccagaagttgaaaagacatatcccaaaagaaagcatttgatgtttaagggttggcttacttagaacacaatgaaaaatattactaaaattaaaactatgattttagctatttttaaatatgacaaattaaatagcagaacattttaataaaacattacttaaggtccacaattttctgtaagtctaatacatgggtcattaaaataaaaaattccccatgatttatggaatcagatttttttaatacaacgaattctaaatggttttataatgccaattccaattaatatcctaattataacatgtcatccagaagggttaatgactaaattttattaatatttgttttctatttattttgatttgtgcagtttatgtgtatagtaacgatagctgcaaattagataccattagcattaaataaggtatatattttaatagaaaattaaagttaagtatttgagctagcctaaaatattcaacaacttaaatttgttttttgtggatcacatttttttgagacaaagtcttgctctgctgcccaggcttgagtgcagtggtgcattcatggctcactgcctcaaccatccaggctcaggtgatcctcccacctcagcctcccgggtagctgaggctactggcgcacgccaccatgcccagctaattttttgtatttttttttagagatggtgtttcaccatctggtctcaaactcctgagctcaagcaatctgcccaccttggcctcccaaaatgccgagattacaggcgtgatccagtgcactcacccctgtgaaccaccattaaatagctaataaaagatgcatgtcaataaaaataaacaacttactagaatgattatgtgaaaatcatttattcttccaaagcatgaattttcaaacacaccttttgttactgttttaagaagggaatcatttccatatatttgcatgtaaatcacttttagtctcagagaactttccataaaagtttttttattactgctgtaaccgatagagctagtggactattaatttaaaaagctgtacataaaaacacatctatagctcaaataatctaggataccttttagtttggggaaatgtagatgaaaatgaagtaattacagaatccttgttaattttcagatttagacagtctaggcaatatctttcaggaatgaagagatatgtgttttttggcatcttggtagagtatattcccattgtaattcttttgtgaagtctagaccagatgtggccataaaaatagacccctactacaataatatatttcatagataatccaataaagtcaaatcttattgcagtaggcttagaactctgtttgcacccatggaatttatatcagtttttggcaaatcctttcatctctgaggatactttttcatctcacatataccctattttctgaacattttgccttcaaagtatacctcatttatcaagaatttctctttattcatctgacttatacaagtggcaataacaacgtctggttcccatgaagtaaccagtgaccctttgaaataatatagcgctggaagaaagaaaaggaaagggagactgatcattcagcaactctttaaaaccatgtcaccgttaaacacatagtttattttatcttttttttagaattgtgaaaacctatattagcatcttcacggatgtctcctttgtttacatccccgcttctgtgccttgcctgcagtagaaaaaaaaaggacatgtgtatccctattccccattgtcttctcattctacatgagaatgagaattcttttaatttcttctctatctacatgaacccacttccattatctgtttgttcagttctttaaatgccctgaagctagctctgtgactgggcagttgaaagttctggacttagcatcaggttaatttgaaaaatacttattgagccaccaccatatgtcagccactactgtagatgttttgaatgtgtcagtgaacaaagcagaaaagatgtatgccctctggattcttgggggtctcaaatagtgaaagacagatacgataagtatattgtatagtatgttcaaaagtgataagtgctgtgaaaaaaaagaagaagggtaaaataagagatggctcatgctggagtacattccaattttaaatagggtatcatggtattcttcattgagaaggtgacatttgagcaaagatctcaaagaatgaggcatggggttgaatcatgtagatatcagcagtaaactcattttgggttcagtaaacagtcaatgcagaattcctaagccatcggtttatctgctgtttggggctggttatctgcagtgtggctagagtgaagtaagtgagagaggtttaggagagaatgttagtgaggtgagggtggacctttgaagccattgtaaggacgtttttctctttctaagtgtgagaagatgatgctgactgagaccagggtgataagaaatagtcatattctgaacgtgtttggaagtggggccaacaaggatttctggatgaattggataaggggcatgggagaaaaatggagtcatgaatggctccaacgtttttgctctgattaactggaagggataaagttgccctaaactgaaataataaagactatagatagaatggggcgattagggaggcattaaatttggatatctgttagacatatcaccagatatattgaataggcaattgaataaatacctttagagttcagcaaaaaaggtccaggttggacgtttaaatttcggaggtgtttgtataagataacatttaaagctgtgatatcagattgtatcactaaggaagaatatagatagaaatgacaacgtgactaaggactctaacattaagaggtggattgacaaaggagaaaacagcacaggataatgaaaaggaatgatcagccaggcatggtggctcacacctgtaatcctagtactttgggaggccgaggcgggcagatcacgaggtcaggagttggagaccagcctggccaacatggtgaaaccccatctctactaaaaatacaaaattagctgggtgtggtggcacacacctgtagtcccagctgctctggaggctgaggcagaagaattgcttgtacctaggagacagaggttgcagtgagccaaaagattgtgccactgcgctccaacctgggcgatggagcgagacttcatctaaaaaaaaaaaaaaaaaaaaaaaaaaaaaaaagaaaagaaaaggagtgatcaatgagatgggaagaaaaacaaaagtgtgtggtgtcctcaaaaactgacgttctattttcaaaacctacattttgggtctccttttactatatcctgactttctagctatataaccaaaaggagaaagcagtaatttttttagatataacatgttaataactctaagggtattcaatgaatctgaataattcagtggtataatgtgaaaaaatatagtattcataggaaaaggaacagaagttagctcaggaaatgacttgaatgaacaccgaagccaaatctccagcgcaggtccacgtattatttgtctcagtggttgaattagcagcaagattccttagtaggatgaaaaaagatgttgtgagcatctgtatctacatgactgaattaaattcctccaacaatgaaatgtagttaacgtagtatctcgaaaagaaccctaagtggaattcagggaacctaaattccaaccatggttttgctgctgactgattgcattcacttcaaatctatcattaacctccttgtgcctcattatcctcatttcaccaaataagaaaaatgaaatattcctccttccctacctcactaggatgttgtggatttaaatgtgtgagaagtgcttgagatgcataaaatttgatggagtgttttattcatgaattcaaggcatctgaagtaatttgaccatgatggacagttgcttccttgcacattttttagagtgacatttccgttactgacccacccatttatgcaacatgttgcctaatctaaatttaggtcaaaacaaattgaccttataggtaagcattatatctattaatattgtatttttgtattattttataatattcatcattcacctattttctcatgcaatatatgttactgaacacatatagattaaaaagccttcatccctaaataacaatgatgggaccttccatttttatatccctctggcatttaaaatgtgcttttatagccatcatctccattgatctctcagtcccttgaggttgatatgacagatatgctttttccattttaaaattacggaactgacagtctcagatgactttaccctccaactactgtgtgaagaagcagggtctggcactgaggtcttctgacatccagtgtagagcactatacttcacaatatggccattggcttactttattacaagcactaaatattttccactgaatacgtaatacctagaggagaatgtcgtgtaaaacagcagcagtagaacagaggattaaatgacccattttcttgaagttatcttagttttaaagggttttttcttcatcactaatgaccatccctgactaagaaattattctcataatacatgataatatctgcgttttccaatgcgacaagaatgttaggatgtctatacatgatcttgacaatccctagctccatcacaatgtgtccaaattcattttatttggctagacaggcatgtagtcttactttcaatggttggctctgctggatgctatgtgatctagaacctgtcacttaccccttctaaacttcaggaattttttatccttaagataacaagaaaactcgtacctgtttcaaagagctgtttgttcaatcacctatccattgattatcttctatatgccaaatgtttttctaggtgctgaattacaggaatgaatcagaagcaaaaagttcttactctcaaggatcttatatgctaatgaaatagatgttaaaaaataacaatttttgtttcattttattttattttattttgttgagacagagtctcactctgtcacccaggctggagtgcagtggcacagtctctgctcactgcaacctctgcctcccgggttcaaatgattctcctgcctcagcctaccgagtagctgggattacaggcatgcgccaccatgcctggctaatttttgtatttttagtagagatggggtttcaccatattggccaggctgttctcgagctcctgacctcaggtgatctgccctccacggcctcccaaagtgctgggattacgggcatgagccagcgcacctggcattaaaaagtaataacaatttttaaatatcaatatgtcttatacagaaaagtgagcagtgtggtagagtgtaactggaatgtgagttgagacataacaccagacagagaagccagagaaggacttttgtttgaggaaatgacatttgaaaaggaacctgaatagtgacagaggcagatacctaaagaatatgttccagacaaaggaaacaaaaagcgtgcaattgcatagtcaacttagcctacttgaggaaaagtgtgagtggattttggtgatggagaggtaagtgccaggagatgaagggagagatctggcatgcatcagatgatgtgcagtcttccgggacgttgtaaagagttgggctttttttgtttataaattaaatgttaagccattggggtttttaaccagaggagttatgtgatatgatctatagttaaattatgtttgttcttggatggagtgtgcattatgggaatttatacagaaacaagatttcacatatatatatatataaaactcagtgtcaatagaaaataataaaaacaaattttatccattgataattctggcattgatagtagtgggtatggtggtaataattgtgtgtaacactcaaactttctgaaaacctacacttgatctgtaaatccaaaagtatatgtagcaaaagccataatctgctcttatttctgcaccacttgcaccagtgtggagtgataaggcaaattattcaggcacctgtgtaagccttcagtgtcctcacccccttgttataactctccactaatattacattggtaaagacgtccctgacctatatgtcactgagacctcaaagaaaagagcaaagctaaagcgtaagggggaaaaaagccagcttaaaaagacttaaaggtttctgggaccaaaaaaaaaaaaaaaaagtctttgaaaaatgagaaaggaaggatagaagaaaagattctcctttggtcaatctggccaacctttggaaataaaaagtattgtgttgcagctaataactatttgtcactgcaggcacttgctgatgtctgccctttaaaatgacccaaactcgttggcctcgaaatcagaagccaaggaaaaaatcttggacataatgttttctgtagaattaccaattttctctctctctctctctctctctctctccctccctctctctctctctctccatatctatatatatatagatgtatatatattttttctgtaggaactaccaattcctatctatagggactgattgagaagtcccttatagcagtttttctttggcttttaggatgcaatgattattggtgagaataactctttcatttcacatttgtcattggcttatttgaatgtaatcctgattcaatcgttatgatctcctttaagtaggaagagaagctggtattacattgtaggattttaattttgtactcatgaaacttttgaaaaacattactcatactcttctgactgtcaaattggcctctaagaggtccacatctcaagaggtatcaagcattggtaactattttttggtgttgttttctcatcataaaatgtacttttattaggtgactttggaaattttattgaatcaatgcatgacactgcctcattctagtaatctgatgaagcaaagctgaaaaacaaaatttgaggattgtcagtatatatacttttatttgcagtcaagagttatgctgcaaaaatggtttattgaagtaacaaaattttagctgatatattaatctgaaagatacagtatacatttttagtatggaaaagatgaggaaaaggaggttctctttcctctaggtatctagagcaaactgtaactgtccttggtatttaatttttggctaaggtactgagattagaggtggggccttagatatgattaattgtcagactgataagctagatatttcattgagtttctgttgtgctctttctttcagatcctctgttcgatgctttgttataaagatttgggcatttcaaaatcttctccatatctggtgtctttccaaacagcaggtcatagactttacacaaagaggaacgacacaggttataagtagaagtgttttaaaccctgagttcctatttcagttttgctttcttaaacatattttccttatgtgataaatgcgagtgttgaatggtgataaataccacccataggctttaaagcctaaatgttgaatttgacactgagagtttaaaggcatcatgaaaatttctccagaactaatgttcaagcaatttaggttttacaggcaactcaatagttttgaatgatgtagttattttgaaaaagtcaccataaaacgctatgtttagggaattggtactttgcatttatcagaagattgtaaatgtcaatcgattggcttgctatttggaatataattttttaaattatagttcaaatcattaggatttaattcatgattttgtactacaaactaaatctatgaaaaatatcagatatttattttaaattagaggcatgtaaaggaaaatataaattttgaaatgccattttactggatttttctcttcagcccaccctaggcatttgttacataaaatatttctgaggaagtcttccactgattttgtaaacaaacatgttttattgaacagttctttgttgactagattaacattgaccattgtatgcaatgcattctcaaaatcttagaagctggttttctttttaatcatataattttacttgttttacagtgaaattaatgcatgtaaaaagtatacctatatagaaagttaaaagaatattgctaactagttactatacttccaaattgcctattttctgtgtcttgcattggacagtagtgattacctctaaaagaaaatggatggtctttgtttcattgaagggatggataatggacataactggcattcttgagcaatgcaattgcaaatacatgtctttgcatttatggtccaatcatcttcttactatgatagcatataattgaaggttcaaataaatgcctcgtcccttcctgtggcatattaaagagaaagaaaaattagaaatactttcaaagctacctcacatactaatggtagagttgtttgagtatttaggtgatttaacaaagctgatgtattttattatgcttgatcattgaggaaaatttatttatcggaatgcttttgagagcatatatattgtcagagataaacacagctggatattaaagaggtaaaaacagattttattcaatacctcgtgaaattaggggagagctgagatccattctaatttgtgcagaggcgacttggttgttttaaggcaagaaggagggagaaggagtgggggttcattcgagttagagaagtaaaaaagtacaaagggctggacagtgtaaatgtgattaggccagctgtgttagctggaagttattgaagttaggattctatcttcccacagagaacaggagacagaggacttatccttcttgatgatgtcatttgaaaagaatggctttcaggtccttgagtgagagacacttctgatttccaagagctacatgttcacaattgtaagcccttttgagtaaatgttctaagaaacggaggtaagagtcctatcaacagatgtgtgttggctagaacaaacattaaattttcctggcagcactgagctttctcaagcaggcacttaagggaaggctagggtcatcctagggacatggccttctggggctagaaaccatactagagtttagtcaagtcttagtgcaagggtttggacagagttgttaagtgctgagagttctgtatttctcactgtcacaaaggaagatcagaagctcctgatacttttttcatcagtacaattgaatatataaatcctatacacaaaaataaactaagcttatacaagcatattggtcaaggaatgttgctggccttattaattagatagcccagttaaaagaagaattttttaatataattaatgttaaagtaggatgatagtatataaaacgtgtctactgtcctgaatacaaactaaactgtttggtttagcatttacctcaagatctcttaatatcccccaaagggtccctaaaaccacaacttatctttgtgctcatgaagtagagaagagacagttaatagacatttctagctgatagactgttgtagagcagagaacgctctgtgtttttgaaaattaaacatatgaatttgcccctcttcccctattaaggaagaagagtttcttaattgtgcgaacacatcaagtgaactattcaattagatttttgtgacccagggtataaacatctggttaaggttacatatttcaaaggaacaaaacactagaaactcttggttttaaatctcatggctggaggataatttgcagcagagatttatctggcaagcatacagaattgctgagactgttctaaagatgtaagtgtgggtgtttgtgtcgtgaaaatagctgtttacatctattaagtggataccgatggttgaaagtgccgtctatgtcaagtttttaccaaatcaacttttgcctcactgtgtcagaccattttacctaatcaacttggactgctaatgtcctttcccctggcaccactatctgtctcttttgcaaagcacagaaacggcatgcatgattgtagtttataaaacacatgtaccaatgtggtctacagcttctgttgagttcgagagggtcagtttctgtaatctcttctggcacagagtcaagaacagcttcactttcctcctgctacctctctacccgtaagtgtgaacccatcactttgctaacactcaggaaggggattacacaaaatagagcaggagccctctgacctgaatatgcatctgagccctagccatagagcttctgattcagtagatctgggatggggcctaaatatttgcatttttaagtgtataagtgatgctgatgctgctggttccaggaccacattttaagaaatatcgataaaggtggagaattaaactgcagctcagaagacctgagttcttgccccagcttgacttttacaatctagcaaatggataaaactcgcaggacttcagttctcttcatctacacagtgagtggttagattggctttgtaatttaaaattaaacagggtttgattctgattcactacacaaggttccaaagaaggaatgatatctcctttcatttcttcactttgtcttctgtccctaggtaatcttatctatgttcctgatttaacctaactaatgtttctgcaaagcttctaatatttacatctccagccctgaaactctcatttgaatgctagtcttatatacatacccccctgcctaattgacatctccacttaaatgtatcagaggcaactcagactcaacaaggaccaaactgaatgttcgaccttgtccttcaaacccgatacacatccaggttcctccatcccagtgaatgacactatccagttaagcaagccaaaagtctggattttttttcctcactcttcctcactgtccgtcaactaccattattaaatctgtcacctggtcctactgatttaaccttctcaatatctctacagtttttctttatgcccattagtatcctagtgcaagctaccatcgtctctcattggaattaacacagtaacccccctacccaccagactgttctgcctacagatagtgtgatatttaataaatataaatctagccttggctagatttctccttcaaaaggttcacattaattttagccttaaaatggtgtgcaaagctttgcatagtctgtcctttgctatgttggcagtattttttactatccctctcatctgctcattctctgtactccaactacactaactttgtttttttttttttttagatttctctaactacagtgctgtaatctctttttcctttgcacgtactattccgtttgtcagggaatctgctcactgtctccacccactccacacactcacgttttcctgcccgtcttaccggtcttgatcggttgtcacttgctcaggaaggtttccctggtcaccccctccacaaattgaattaagtcctcttgctgcatgctgtcctagtgctctttattttcctctcctcatccttaattcagtttgtaattacatgttatttgtgtgaggatttgattattatctgtgtcacccactagatattgggcattctttacttactcaccactgaattcatagaaccacagtaattgtacacaacaaatattcaagagaaatttattgaattgatgaatgaaaagttgtaccttaacatgttcctgacatgtatccaaaaaagagctcccctttggggtctattaggactttggacctaggtaaacgtaaccctagtttcgctcaggtttaaacagtagaaagtaattgggtctcttttgcatgtggctttcctaagggctaaccctgtcttcggaatgagtcaatacagcagagctgttgaaagcagactctagcttcggacaacgttggtccgaatcatggttccgtcatttcttagctgtgtgatttagaataaattaatgttttaaagctttgatttcctcttccttaatctggagatgctaataaagccaacttcgtagaggtattgcgatgagtaaataagcataatttgctgtaaacaccttgcagattgcctgttgtatgctaactaatcaataaattgaagctcttaacatcattatattagatatttccagcattgagtatactatcaggcatgtggtagaagctcaatataaagttttgttaaattgaatagattccatatatggtatttctacagcattatgctccttatttaagtgtctctaagtattttttaagtatcacctcacaaaagacagatgtttaattcattacacatgtgaattgttttagatagaaaataaaataaaaaattcaaacattgaaatcaatagtgtaccttaccttaggattacaccataaaatttctaccaatcgagaataaagtgtacagtctatttcctttctaatacttttaacgcaacaaatgtttattgaacacttactacttctaatctatgacagacataaagatgaataaagcatgccacaatgtttaaaggagctcactatatcataagaaagcggattcacacagacaactctataagataaagtggtaaatttaggctggcctgtgaaacaaaggattataggtatagttaagaggtggaatttattttacttcgaggatttcagttacctttatattctttgtctaacctttcatgtttctctttcttcagaaacagagcacctttttcctgacacattcatttccccctatggagtagagcagttgttttcaaagtgtgggtcccagatcagcatcacggggatggttagaaatgcccattcttgagcctcacaacagacctactgaaacagaaattcttggagagtggagcccgcagatctgtgatcaagccctgtaggcaattctaacgcacactcaagttaaagaaccacgggaagaaaggtccatcctgtaacaagacagatttttttcattagcatcaattttgatcatttatatatatatatatatatatatatatatatatatatatatgcatgctcacaaaaccattcaccttactaggttttagtattccccttcctgtattcatgtggtatgtatgtatacaagatgaacacacatttacctgagacaaggtaagactacacatgtctcatttggggaccagaggctgtaatcttactcaaggtcaaagcgtcttcactgctttctttcactgcttttcaaaagtaaaatttccatgtaggtgtcatttgttttctttttgtgttttagaaaaccgattaaggggtgaagtctggctaaacttagtgtcaggacatttacttagataaaattattttaatttatcttgtaatgttcaatgtgagaagaaaagtccttatgagtagtgtattccttaaataacaacaatttaaaaactaccactgaagtctgtcagagtagttttgcctcatttgtctagataagagaaaaaaggttcacattagggattgcaatttgtctgccaaagtgcagtttatttattcagaaacatttagagaggaatgtgtcagttctgttgcaggcactgtgctgtgacggggagctcaagatgatctcaaaaaatttcacagatggggtgggcagggggcacagagagatgtatttagtggttcagatactatttagactgtggccagcatttctctaaatgcaatccagataacaccttacagaatcatctgggcagcttgataaaagctgtagactcctacccttcatcccaaacctattgaatcagtgtctgtgtgtgaagacctagattgtgactggtaattataccaaagtcttagaagcaactctaggccagtaatactcacatcagaatcagctggagggtttgctataccacagattgctaggttagccttcagagttgctggtccagtaactttggtgcaggtccagattttgcatttccagcaagttaccaggtgatactgatgctgctggccttgatcgtgctttgaaaaccactgctttagctacgctataggaaaaaccatataaggcttttatactggccaatgacttcacaggcctgaattttagaaagcccccttctgcagcttggcctatagattcgaaggaaacagaactaacacaagaaagctagttaggagctagttaaaaatcatcctgacttgccaaggaaaggtgctgaagacctgggtcacagagcaaatgcaaaacactaggactttgtccctagttcaccattaaatcaacttattttctcttaccccctcatattcacgtttactccttactttgtagtggttggacaaaaatcaaataaatctgagaattctaaaatgcacacccttgtttattttctaactcaaatatgccactgttgtctgtgctctgtcaagatttcaacacatctttttctcctgtttgcttttccttttggcatatagtgagtgtgtgtatacacacacacacacacacattttttttgactccttccaatgcccttctgctctccgcagatacacttctgcattctgaataaaaccgaatacatatatatatatatatatatatatatatatatatatatatatatgcacacatattttgaaaaccttatttgaaaagaaagctttcggaggaaacgttatttagccacttaatcgagtcttttactgagggactttttgtcgtcccctaacttcctgtcagcagtccacaggcagcaggaataatgtgggagaagatcaacaggcttatttcaggaggtcaggggccagtgccaccacctgcaggtggagacatcagaagcaggaagcagcccaccagctgcagggagaactccccacagagcctaaccaagatgaagggacttgtaaatttcaaccctcccttttggcttttgtgctaaaaatgtgaatattgaggtctgccctgattaagaactagatacattcctctttgtgactgccacacttccttagcgtattcattttttgtctttcgatctcaagttattattttcaaatgcattgcacgtatctaccatggataccattgcaattggaaggagcaaacgttttgtatgtttacttgacaaagagaagtgactgcccaagccacacagagttctgcacaaatcagtaacttctaacgaacgtttgcacttccgggcttgttctctacctatttcagtcgatgcatttgtattatttacttcaaactccaatactaataatgcctcaatcaggttgcaattgggatttgagcagccagaatttcagaaatttggtttggtccatatctgtgacaggtcagtaaatcagagaagcaagggtttggttgctattataatacattgcttacctatcaatttagttatcagccaaggtggttgttatcatccaaagtggctcattaaccaccttggagactcagtatacaattgcaagtaaccctggaagttgtaaataatcccaactgaatttgtatgagtttggtaaggttaagtggaaaccagctgcttagggccttgattataaatgaagttaggagtggaagaagtaacaaaaccccaggcaaattcattaaacattttttcccttcaactttatgctcacgaatgtgttgagactcttctgaatccataaaacacctttcagcatcatctgggcagcttgataaaggctgtagactgcctgcccttcatcccaaacctactgaatcagtgtctgtgtgtgaagacctagattctgactggtagttataccaaagtcttagaagcaactctaggccagtagtactcacgtcagaatcagctggagggtttgctataccacagattgctaggctagccttcaaagttgctggtccagtaactttggtgcaggtccagaatttgcatttctagcaagttaccaggtgatgctgatgctgctggccttgatcatgctgtgaaaaccactgctttagctaggctataagaaaccatataacatggacaaggcaaatgaaaaggttggaattcttctgaatcccaacacatttgtgagcataaagtcgaagggaaaatgattcttctgaatccagacacatttgtttaaggataaactgttttttccttctgaaaatttaatgtctgattctcgttcattcattcatcaaaagttatcaactatcaactataggtaggaactgtgcaatatgctggtgataaagagatgaaagacacagcccctcccttcaaccagctcctagttgaggtggcaagtcagctgtataatcaagtaattgcaagactgtgcactgaaaagggtgaccacagggtgtgatggccacccagggctgtggaatcagtcccaaaatgaagaatgaaagcagggaagggtaattcagaaagaagaaacagttcgcataaagacccatagataaacatcaatcagatgtggttaagacaaaagtaagtttctggaggctgaggaccttctcagctatatgtttgcagtgcttggtatagggctttatgcatctacatggaagacagaaagggccacatcacagtggacaaggcaaatgagaaggaggcagtatcagaagatgagggtacaccggagatcctagttatatatgggcattgtgttcatctcaggagttactgagtaatgggaccttgactcaaatgaatctcaagtctgtttttgcctaatcttggttttaggactaggattagcatacaaccgcactaggagcctagttatacgaaaggctgcattgcggacctgatacagttcaatatacatactgtcaccttgcaaatagggttacgttagttctcaagactgccaatcctctgtgctctaatccttttggcttttttttttttttttttaactgtctcactctgtcatccaggtgaagtgccctgggatgatctaagctcactgaaacctccgcgtcccaggttcaggtgattctcatgccacagcctcccaagtagctgggattacaggtgctctggcgccaccaggccctgctaagttttgcatttttagtagagacagggtttcaccatgttgcccagactgatctcaaacgcctgacctcaagtgatctgcccgctttcctttggcttttaacactatagagcaagggtccccagccctggggccacagaccagtacaggtcagtgacctgttaggaaccggggccccacatcaggaggtgagctgcagggccgccagcattaccacttgagctccaccttctatcagctcagcagcggtattagattctcataggatcacgaaccctattgtgaactgtccacacgagggatctaggttgtgtgctccttatgagaatctaatgcctgaagatctgaggtgcaacagttttatccccaaaccatcgcctcccacgcacctctccccacaaccccacccgcccctgatccatggaaaaattgtcttcctctaaaccagtctctggtgccgaaaaggttggggattgctgctatagggcgatggttttcacatttgatcctgcatcaaaatttccaggtgactcattaaaatactgattgctgtgccccactcgtaggagttctgataaggtagctgtggggtgagacctgagaatttacttttctaataagttcccaggtcatgctgatattgctttgataaccaaagcaatatcagctttggttatcaatatataaccaaagccacatagagggggagaagttccttgggtttagcccagtgtttactgcgaccaccaaaattgctggagcttaaccatggctcagagagttatgttctgttcactctgtaggctgctattccctgtcaccttttgaactatgatggaggggaagagctgccagctcaggagatttcacttttttctctgcataattgaaaatccagaaacacagggttttgggaaagctatagaacagatcatcagtgatcagtgtttaataaagtaaagcaataaactttactgtgtaaaataggatactttattatataaattttgtccccttcccccacctcacaggccaataaaataatatacttcttgtccctgggtgtaatgttattggaaacctttgaatgtaggagaggcatgggcttgtaagttgcagaaaactgctagcctaggattgagaatttcatggataatccaaaaatagatgattttacagttataagccttacgtgaacttgaggtaagaaaacacaatgcctttatagtcttctcagttgctccacatgccctctgagattctgttctgcccagcctctctggttgtcacatctctgggcattaacagaaagttcacatactctttgtctctgatgataatccttctaggtccatatagaagatccctatccaaaccatcccccaaacaaacctattggttaaatattttctccaccgaaggcactttcttagattctaagtgccctgtaggcaggcttcctctctgatttgggagagtacaaattgcgacaaggttaaatcatagcctgggaatttgacctaaaattcactcttctcccatatgcattcatgaaccttctgctggtttttaaaagaagctacttaatgtcagctcgaagaggttggaaggggttaaaaacatgagcatggcagtaagaagatttatgaaggatctgagaagattatgacttgatcagatggtattttgtcagctagccacatttgtgaagacttgaaaactagggaggcttgtccttctaagagggggcactgctgggacctggattctgtggaaccgtattagtagaataaacaataacctttgcttgtatcaaatgaacttctattctcatgtgtcttttgacatatttttattaatcatatcactgggacctccttgctgaaagatatctccgttccccattctgatgactcccaactaggagtgagatcaaatgaagatggcatggaccatttctccatgtgacagctctctgtggttgccttttaacacttctaatgccctttctcttaagaattcccatttgtcgtctggcactggtgctgtgatcaataaaaatgtaatggagtgaggcttagaaacatgaggaaatttactcaagctatccatttattgatgtgtccatttgtgttgtcagggaagaaaaactttttcactcccctcttaggttcattacttggggggctgcaaattaaactgacgacagatagattggcaatagaaaagacaaagtttattcagagaagtatgtgggagctcacagaaaacatagctcaatgaagttagaatttggggcttatgtactattttaacaagggttttgaaaagaagagtgttagaatttcaagccacaaagttggtgggaaatatgaaagaaactaatgaaaggtaatgtttgttttagtaaagtctgtttatgtaattttcttttcccagcgacaacttctcatctctggtgacaggagtcactctttacccctggtgcaagaaactttccttaaaggaggatttaaaacagttgaattatttcagaaatctttgcttttaggcagatagggggagtacagaaaaagccccttcccgtatctgttgatcctcaaatggctttagctcaaaacaatttttacatcacgatggcataatgtagatctcttcaatgtgttcatttattccacagatatttgtgaagtacatgatatatgccaggtacttgggatacaagaatacataagtatgtccctagtctcgtagaacttacactctagtagtgagctagagaataaatgatattatttattatatgcatacacatatgatttcagatagtgatccatattggaaataaagctggttaagggaatagaaaatgatattgaaggtggacttgtttagattgggtggattggcatggcttctctagggggcagtatttgagcagatatgagagcagatattctccaatttgggcaaaaacattccaggcagaggaaacaagggcaagggcactgagttcaaaagagacttgacctagccaacaaatagcaaggattccagtgtaagagaaggtggggaaggaaggaggtgcaagtataggcaagggcaagatcacacgggatcttgcaggccgtgataaaagaatttaactctttcataattttgacaggacatcattgaagaatttagaaaaatagagtggagatacctgatctgctttcttcaaagagttcattcatcattgctgagtagaggttagactgaaatggaagcaatagtgaatacagggagatagcacaggaagccacgttactagtccacatcagaggtggttcagactagggtggagtggtggggtcagttagagagctggtatttaggatacattttaaagacaaagctgacaggatttgctgtgatgaattagatgtaaagtatgagaataattgagaattatttctaagttctttgctggggaaaagtggaggaggaaaaagttagggtacaaggtgtgatgaaatcaagagtctctcttattatcagagtctcattagatatccaagtggaaatgctggaaagaaagttgggtagatcagtctgaagctgaagacagatactgtgactggaataataacgtaagagttggccggacacagtggctcactcctataatcccagcactttgggaggccaggataggagaattacttgagcccaggagtccaagaccagcctgggtaacacagcgagacctcgcctctacacacacacacgcgcgcaaaaattaatcgggtgtggtggcacatgcctgtagtcccagatactcaggaggccgaggctgaaggatcacttgagcctgggaagtcaaggctgcagtgagccgtgatcacaccgctgcactccagcctgggcaacagagtgagaccctgtctcaaaataaataaataaataatgtggcagtcataggcccttagatggtttttaaagacatgggactggatgaagtcttctaggaggagagtttgggaaaagagcccgagaattgactgcacctttcaaaacaggaggaagaaaaaaaatactcaaaggagacaaaagcaacttctgtgatttatagagaaaaccaggcaagtgggatgaagaaagtccttcatgatagaatcaaaaacagtgtcaaatgttgaaaatacaattagacaaacacaaaagaatagaccattgggttttgcaatatggagctcatacttgaccttgataaaagacattttcactggaagcatgcatcaaaaaactatttgtggtaggttaaaatgtagtaggaggtgaggatatacagacagtggctttcactgtgcagatactgctgctcatgcactaattaaaagacatttgttgagtatctactatgttgtatccattgctaaatagtaacagctgggtttagtcaggtagaacagcatcaaaatcattatagtatcccaagataggtacagtaaaatctgtgaaggaatcagagtagtctcttctccaacagagcgtaagacccagcttcacggagaaggtggtagattagctcatctgggaggctgagtagaagcttgtcattatagagggagaacatcagaagtgtggacaacagcttgaataaccttgaaaggacaaaagaggacggtctgccctggaaatattaagaagtctcacatgattagacacaagatattaggggaaaggcataaggtgaattgagtcaatgaggtcaaagagaagctagctggaggaacaggcgatcataaaatgagtaaaagtatatattcaaagattctttttagaagggctacacaggatggataaggggagagagagagttgaggcacagagacaaattggaaaggtgcaatcataaccagagacatgaaaaacccatagaaatctgatgtagattatgtggtccccaaggttgaacaattaagtacgctttcagttgttatgcccatgatattaacatattttataactgcaataagtgctgaagctaaagataaatacaaacaatgtaattcttattctgtgagaaaatgttgtagctggaagttaaacatgtttcttagctaaagaaaaatattgtgtgatctggattacttaatgttataatttagcaacaaaatgttgacattgagccttgcataatcaaaaaagtagtctattcaataaccacattctcagaaaaaaaacaagaaaatattagaaacaatgataaattatcgtagtaatttaattcagtattctattgttttatttggatttaggaaaggcagaaatgttgaaatattaatatatatccctgtaataatataatttgtgtctgagaggtaggaatgagggcatgaggtcaaagtttgataatgaacttcaaagctataactatgatcaggaaattaaaattggacaataaattcctagaatcgtcaggagttgcttgtgaaatcgagaaaggaaaggatatacacaaaaataaagaacagccaatgctctcaaaggagtctaacttttataatagtcttctgtgttagagctgaactcttctggtttagaaggacactctgttgcctggaaatagggcatggaaaaagtcatcagagtcatgtcatctttcattcttcccatgaacgaaatcgaggccctgaaaagtcacctgtgtttgctgtattttattgcaactaagatgtgcatttttaaattgatacataataattgtacatatttgtgggatacatgtgatattttgatgcatgcataccatgtgtaattatcaaataaggatatttctgtatccgtcacctcaaacatttaccattgctttgtgttgggaacatttcacgtattttattatagctattttgaaatacaaaatagattgtcattaactatagtcaccctactggatgcaccttgtttttaatatttctgaaaacagatacgtctcataggtgatggtgtcacagctgtgcattagttattattgcctgtgcaggtgcaaacgtaactattcatattgttgtcaattaattaaatagttacatttatttatatgcgtttattatactaataaacacaatattgagatagttgagctctagttttgactctgctgttaactagctgcgttactttaatttacttaactaatttggctttcaaattcctgataagtaaaattacaacatgagtttctcctgctataatagcctgagaaatcggtgaaacacatgaattcagatgttgatgctatttaatagcgggattccagatatctacttgccattatgggagggagagaggaggtggactggaggctgtgatttccctaggaggttgttaaaattggccaggtgaggaaagctgagacagaccataaatatgaagcatgatacctagccctcagtgttgaaagaaaatcaaatctcatctttgtggtctaaatatcagtatgatacaatcctctgtgtagacatatcctctgccctattgttttctttctaaaagctaaagcccaggtgtgatcacatccctccgttatttacaaatttctgatgatgatgattcttctaatatctacattccttaccattaccatgatgtccaaaacctattataatctattcgtctccaagtgccatgttgtggtcaccctatgcaccctctaaacccaccatatgaccttcccgctgctacttgaatacagttggccctctacctcgttgtgtctttgcattgcctatttaattgcctttccattctctaaatcactctttcgctggaccagcaacatcagcaccatctgggaattcattagaaatatagatcctcaggcctcatctcagacctgcttgatcagaaacattggagagtggagatgagcagcctgtatttttatcagccctctaggtaatttgatgcacactaaagtttgagaaccactggtctagagcattcttctttaactctcttctaaaaattattagaatgaattcgagggacgggatctccttgaaagccaagaacatttctttgtcatctttctgacttcagggcgtagtacactttttggcccataattaaagctcgataaatgcattctatgccaataaatcagctaatcaaatatattattcatgcccttgaggtatctgaaatttgtttgcagaatgtaatatataactatagagtaacaagagaataatttattgccatagataataaaacaatatcctctgtataataaatcctagcctctgctcaatgggcaaaaacgggactggggtttcagattttaaaaagattattggtaattaaatcacctggagaagcacttgctgcagagatgggacttgaagcatcataataaactgttgtttattatgattcggtcagagctgatggaatcacagggattgtgtgaggtatggaaagtggttgacattgaattccaggctgcacagttgggacttgatatgataaccaaaaagaaagaatgtctggggtggtagcaagctctaaatttagacaatctaggcttatcctaaggagaatatagatacagataactgaagtttgattaaagggaacctggtgtatcacaaatagtaaaaagctgtagttagtctatgcagctatcagctagccacataatacttttgggcaaatacattataaaccaaaagaatgacatggcttatctctgtaacaaagtggctcattgttctttattctactgttatccttaagaaaaaaattttagtaaatttgttatgctatactcaacttcaagaagggatagcgcttataaaaaaattgtttaaagaaacaggcctatttctctttgggagaagccacggagaaacgaaaagaatggaacgtgtgtttctgcccagatggcaataaaatgtagggtaaatttctgtcttttaaaactgtattttttccatccctctgtatatacacatatcctaggactgttataaaatgctgcatgcgtatgtgaaaatggaaccttattgggctgtttgatggacctttaaaatatatttgttggtttggggtacatactagctatgcaatataatccgcattatttcttatgtaaacaatggataaactgtttcacagtccagacatttatttggtcactgtttgtagaatgtctattttatttacttctgaatttgtattccagagatctgccttcaatgttggatacttccactgtaatattctaggagatgctcactttctttttcagcatctgacacagtaccatctgcctcctcttttcttgccacaagtaataacaattttataaaggaggatcacattacagaattataggtggtaaactttctaccaccagatttacccaagaacctgaaacacattttttcaaaaggaaatagaatgtccttcttgtgactacatcggaattttgcttgcagcattatgctttttttttccccctagtgtagctagccatgtggaactgaagccattagccagctcctcatcctataaatgctattacctgggaaaagaggcagaaaatatactctcttctccagttagagtctaaaggaagagaacaatatgggtagttgtgtttaccacaaattgatagaactcctttattttaaatgctaaaaccaaataacttgtttatatgacttcaacattgactatcacacactgttgcatgataacagagtgaaaactacctctattggatttaagtggggaatctatgtctcattctcattctttttttactgtggaaactagttgattccaggatcagccttagctccaacttgccacactttgagttttggtttttcacttgcattgtcacaggaaacttctataggataaatcgaggaagattttactctgcaacgtgttgcagaattaaacatttaaagtggcaaaaccttcgtgtgtaggttgtctccccagagaatgtaaaaatgaattgaaggcagcacctaataggtaaacgacagccaatcaaacaagaacaaatgaaatttgactggcaaaatcaaattgaaaatgtataacgctgaatctcagaatataggaggatgcatagaaactaagctgtactattataaaagtcatagccattgaaaaataatgactggttaatttggttttctttacctcatggatgtgaatggttagattttgatgttggtgttatttgacgtgtgtttgtcaagaagttgccttagtcggctcgcatttaggataaaaaaaatattttaagaaatgtttaagagattatgttggagacattagaaacaaaataattatgcagagggcaggactatcaaaatataatagaaaaattacaccgctcttttatgatttcctcctttttggcatttaacacaaaactttatgattacacacaccacgcactccagaaatgcttaaaggaagatgagaggaaaattcaatagaagtagcaggcatttctgtgaggacagcagaatgatcacttcatctctgtattttttttttttcaaatttctgtatctgtacaatgtcttttccagctctaatattctgtgatttggtaatttccgcactcagattttctttaatgaattttgtatgatattacctatttttataccagatattacctggctctaatttctttttcaccctaggaaataaaagtatcgggtgaatttcccattttcttatgttattgatacaggtctctgttggatatccccacgattaactttcctgcagcatgttcgatggtggcttaaagaagaaaccatgtatcagagccccttgtctatatagacttttagataaagagaaatacatatcacagaattattctgggcgcatagagtctctaaatgcaaaaaaaaaattgtattgtagctgttgattcttctcagatagattgagtgtagagagagagcattccaaaaactgagcagaagaaacacagtctgaatcaaataacatgaaattttagctaacaagtaaataacacttttttcagaatatgcaaataatattggtttattatgaaaaatgtataggctgatagatgagcatagagaaaaaattataaatatcttctttaatatcactttccccagcaaaccacttttaacattttgatacattttcatgttcaaacatttcctaatagtcttttttcctgttatataaatatgaattttaaacattcgtatgtttatgaaaaggcaataagatactgctcttttataacaggctttctgaacttcacaacatgcagtgtattctaacatgctccttgtgttcttaactaataaaaaacctcacgttatttaaaaaaccatcttaaacataattatccattaagagaagaggttggggtagagagtttcagactatcaatatcaaagttatattttctgtaagtattttaatttttaagtgtagctataggtatatgattataaaaccaatagcagagaaaagataccacctttgaatatagttttccttggttccatgaaaatggcctcctttctttttgccagtccctcagtatcattaactcatttttctgtaaatgccatcattgtatcacatgtcctcaggaaaaggcacttttctcttttaagctagtgtttgttcttgttctaattttatggcaatttaacgagtaacaatcctgtttctataaatactgtttcctaattaatctattgcattctatccatgagaatttagatgactttctttgtaagagaaatctctgtagcatgagattcttctttgctcttaaatttcattctttcacatttttaaatgacctgatagtattttgttgtatttgtgctgattttttttaaccaatcttaccttgttgaacatgtaagttgtttctaatatttgcaatgatcaaaatgtggatccaacttcactaaagcgttaagaatctaaaacaaaacaaagaacaaaaagttggctgtcatcttgcttggaccaccccgtgagttactattttcttgtttccggtcacagttcatcctaaatcatttcagtacacaaaatgttttttaaagtttgggacagggggtagagaatgtcaattattcctccaaggcagtcatatgagcattgagtatcatgtggaatagttgttacttgtaaagttatggggcatcaaacccagtcaatatgtttctggaattgaaaaagtccctggacattctaatgatactgttgttcactttgcacctactgttaccactactttgatctgtcaacactgcccgtaatggttaattttgtgcatcaacttgactgggctacaaggtgcccagatatttggtcaaacattattctgggtgattctgtgcaagtgttatcagatgagattaacatttaaattggtagactgagtaaagtagattgcccttcctaatgtgagcagacttcatgtaattaattaaaggcctgaatagaagaaaaacactgaccctcccctgagcaaaagggaatcgttctgcccgactgccttcaaactgggacatgggctttttcctgccttcagactttaaccacaatattagctgttcttgtatctcaagtctgctctacttcgattggaactacactatcagctctctcgggtctccagcttgcttgttcaccctgtataccttgggagttgtcagtctccatagttgcctccataattgcatgagccaatttcttaccacatacaaacacacacagagacacacacacacacacacacacacacacacacacatataattatatatgtgtgtgtatacatattctcttattccttttgtttctctaaggaaccctaatatactccttattactctttctactgccttagagatcttcaaggccaagagcgtaatcctccatcctggctctttttcctaatcattaatgatcaactcatagccatttagctcaactaaaaataatttgttcatgaagctttacactcccacatactgaggaacgtggtacctaagatcaaacagtcactgcctcatcaaatgcattcctcttcaaccccatacaaatgtccccagatggaactcacaccataaaaatattagatcccattgacttttctgctttctcaaggatcattgcagagcttgaaaaagatggctcctccctttgcctaagcaggttaacttggtgtaaaagtacatgtaagatttggcacaaaggaaaataaatcagttttgcctgggtcctaagaaacatttccctctgcctcatggtaattgtacctgccagttgattgcattactcaagtggagaccatgaagtgaagtggtagaacaagaagaaatccctataattttattaagtatggtgaaaaatacagatatgtagagaaatgactgggattagatggagcaaaacataattcgagatcctgatacaaattgtacttcctggctcaagggagggagcagaacattccctgctacatgggaataataataaatgcctgataaaaatgcagatatatcatagactacagaagctgaagtggattcttatggtcccctactcagacagcctctccttcagatgaagaaactgaagcacagaaagctcatcctagtgtttcatattgaaaaacccattcaagtctattttaataacctgttaccaaaaatgagggaaataatttaactttaatgtttcactttgcattacccttttcctgactagacttctatccttttcttgagttgagctcattaactactatgaaattatggttatgggtagaggttaattttatacctgtccatcttctggcatcttatttacactaaaaatcatttttaaatggcttcattttaaaaaatattatttcagttgacattttaaaagacacatcatttatgtactacagaatatgcattttatactctcctttattaattttattattttccaggtagaccaatcaaatgaatcagaaattcttggttagatctattagacagcataagtatgtttttcatcattaaattaagatgaaaacacaattttactttaaagtgtttgacgtttccagcctttataaagtcaacacttaatcacatctgaaatttgcaggaaaaaattttgaaagccttcaattattaacattatttcgggagaaaaagccactttgccgcagaactttcacttttctctcgtgaattaagtctgatacaaattattcattatggtgaagtttaaacataatagagtctagctacttccacaaaaatactattcaatgagtttctacattgacatctaactgaccttgtaattaatgttgtacacgatccttttattatatgctggattatcaaatatgacttattagcagtataaagacacaaagttctgaaatgtaatttatagccatgaaaaggaactgagctttgtgtgacagttaaatttgaagagatcaggtgattattatgaagcatgaataataatgcatattaaactcacgtttttgtttaaatcattaatatgattgttttagaagaaagtctacctctatcatatgggcaataaaatgtgtataagagcaaacatttgtgtatgtgaaataactcaaattaaaaccagttttccacattaattcttacagtttttaaaatttaaatcatttaatgtatcacacatagctttattcattttaagctataaatgttacaatttctgtttaagctgttaatataagctttgtaagagcaattctgtataaatatagaattgtcattattcactaatagctaccatttatttagtgcttgttgagtgcaaaagtactgcactgagatctttgcatatgttctcttaatgttacaattcttacctgaggcatttctgtttctgctggaatatggtctctctgaattgaacaagggaggcatttttggttgttatgatgaaaggtggacactgctggcactaacgtgtgttggtaagcgactagactcttcatgatgcgtaaacagtgtttcctcatacccctgcacattcaaatagaggaaaaccttgtttatagttaatttcccctagaatgtaaatccatttaacatataaacacaaagcgtgttttgtgtggatgttttttactggagcagggagacaggagaggaaatgcagttttgatagttgctgaatttttcaagaatgcagcaattatagaacaatttctagaagtttcctaggagctcttttccatagcagaaaactaggacttaatagccttgcgactcatggtacttgagtgttccatacaactcacctatattcaggggacatttgaaaaattctacattaaaggggattcttaacataggcgcaagtgtctggcatcttcaataggtcttctggtgtggccatgaaaacattcacacgtttcaaagtattttaaaataaaataaaacatatattgttgtgttatgaattattttctttcttttttatatgatggttagatcactgtgcagacaagtttatgagatctattcatttcatttcagggtggtaaatgagggtgttactaaatgttggttctaaaaagggagacattgggtattacagaattcagaacagctctaagccctgtgcacatttagcattagaggacacaggcaaatctggcctccagtcctggcagcttcttcactatgtatatgatgttgggtgggttgctttacctctctagtttttacttttatttctaagctagggctattcatagttctttatcatgtggttactgtgaagtagcaaagcacctgacataattagagcagataaaatgctcaacaaatattgcttatcagaaggattatgtattacctcccgaaatacatcaaaaatatattttccaattcaaagaatatgtagtacaaaaatcatgcctaaattaacagagttgcagtagcccaaggagagaagataatcattattgatttcttcttcctttttgctaagcagttctctgtctctgcctcctcagttgttgtccatcccactcccccactcccaagccctgaactctgaggggtttgctgccgtggccggttctgtagtcattgctgtccaatgatgaaaacacaaaatactgcaacagaacactatgcctgtcagcttagctcccttctttctgctaaatgacactcaatcctattcttttgttctaaaggatatcctaaatgaatagccactggggggaaaaaaggttatataagattgtgcactgtgtgaaactgatgcaaccagatcaatgatgtgaatttctcttaactatttactgggatctagaaacaggtctctcaacttagcagtgtttacgaatataataggccttccttatacatacatctgaagccaatctgagtcaggaagagtcgtggtctgataaatattttgaaaacttgcatttgttctattaaagcaaactgtttattaatagtgtgccttattttttaaagcaaaacatttataaacagtagtcattacaggcacttcagtgtacggagtgatcaattgttagacctttaggaatcgattgtttcgtggagcttcggcttataattgaaatgtcatcagaaggagtgtaagacatagcttcaggagaggccatttatgcgcttttgttttcagctaagttatagagtcatcatgtgaagaaagattcttctcttagtaaaaatcctttaatggttggaataacacttgatatttaatatttctttctactttatatccacatttattcaagtgctaacgcgtgtggggcagcaatgaagcactttattccaacattatagttctcatatctgcgtatgattatttttcatttatcgttagcatatatataatgatgacttttaaagtacactgtattatattcactggaataatgattagctattaataatttgaacactatccaggaaattactgaacatgtcctacaagataaacctcgtatgatattgtctccaaataacagtgctaaccaagaagagtgctaccaagttcaaaagtaatcacagggagtaacctaaatgcagctccgttgggttaaaaatagtttctctaaattatatgttccctaagtttgagatcgatttctacaaggggataaaatgtttttataaattctcagtgataagtcatgtgattaagaacccccaactttttttccaaagacatttgcatctctgatcaaaataacaagatccagtcttagttataaattggggaattttcatcaaaataaggagctactcgttgcataagaagactagtacaacttaaagccaatttaatttcaatgaatgcatgatcagctccattgccaattgagtgtttttcttattcatcagaagatgggttcatcatcgtgtttcatatcaactgttctcaaaccatattgcccatttaaataaatatagatttgtctcgaaattctaaattcatgtcatatttcataaatagcctatggtcctatttattactttaaaatattatagatataatatttttattctaaagtaactgtgttatacaaccaaattattcatttaaatatgtgactttttaaataagtaaatgacttatttaagtaaagtcattaaaattttccagtctgtccttcatccacctgatctttgaatgagttaggaacaatacaggaaactaatacaaacttaattttgattacaaaagatgaaatcattctgttatttattcaacacactatgtgtcaataaaatcttatactgtgaaagaattcgtctaagtccatttgctgttgcttgtaacagaatacctgaaaatgggtaatttacaaagaaaaggagtttacttcttacagttacggaggctgagaagtccaaggttgaggggccacatctggtcagagccttctcccatccaagtactaaccaggtcgaacctcacttagcttccaagatcagataagagtgggcgcgtttaggctggtgtggctgtagacttgttagagcctttttgctcatggggacacagcagagccctgaggcagtgcaggacattacatggcaagaaggctgagtattctaatgtgttcatgtctctcttcctgttcttataaaatcatgaatcctactcccatgataacccattaacctattaatttatgaatggatgaatccattcataagggcagagccctcatgatgcaatcacctcttaaaggcacaatctcccggtgctgccacgttggggattaagtttccaacacatgaaatttgggggacacatttaaactatagcaaaattgtaataaaatgttatatagaagcaatgttcttactgattataattgttatattggtaaagtgttaagtcctctaaccaagggatatatttcagcttattataatagttttaaatttacaattcaatatgaataacatctggtaaaagttcttttcaagaaatgggaaaattagaaatgtttagaagaaaataattcaataaatattaagttcaaactggattcatagtttatgtgaaattctgggaaccaattgcaaggggagaaaatagttacaatagcaatggtgaggatgagaataagagcaggtatcaacgttaattgagggtgtgttatagttctaatcgtgctatgcccactacatgacttttccctgtgtgaggtttccgagcttcttcgtagtaatcctaaattgagctggagagaggctagggtaacttactcacgctcatagagccatagagtagtaaaacctgtatttgaactctggcctgtctgacatcattctgtggtcttttaaaccaccactgcttctccatattaaaactccaaatctaggtgaaaagaagaaaactcagaacatgttctgcaacaaaatataacaaaatataatgtatataaacacttatacataatatcactaatatctttactatgaaaagactctgatacgaacattttacataattcatgcagaagtgttaatcacattgtctgtgatgagctgtgtatgtatctgataaaattctggcaaccagacatcaactcgtaggcatagatctgtaacactaaatatttgcctcgagaaacttaaagaaataaagacaaatgaatgaataggaacatggaactgagtacaagataaaatcctcctaaagcaatcgatgtacttgctgctgcgttattgttctaagcaaaagaagcatggcgaagggagatgtgaagctaaaaacagaatgcttagaaggagatgatagcaggagggaagcaaagatgggaccaagctcccaaaaggcgggctttgaacaaacaaaacagaaagctaagcctttgacggatgcacgggatgcaagaaactttagtcaggaaagaggaggcgaagaaaaaccctccaaagaaaaggtgaacaatattttaataggcaaattgacagatagcaagagatatataccatgctatgttttctcattgcagctgaagacaaactggggttatttatgctttgaaaaagcgtaaatctaaaaaacaattgtggaggaagaagcgatgaaaacacgtgttaatacagaaaacatggctccaaggctttaaacttccttgtgagataaatgcatttacattttccgtagtagctaatatatatatatatacatatatatatatatatctgggaaaataatacacagtgattttctttctttttttcatctacttatgtgagaaaaaagtaggctatctgaaagcttttcagttaaatgaggaagaaagttaggtgatcttgtaaataatatatatgttcaagataatgtaaggcccttgtgtagttttcaaaacttatctttaatagcagtttcttctggggatggggtagttcaaagttgaaatgttagaaagatgttaactttttttcctttttacttctccctttcaggatggaattaacaaatttgattacaaatagatctcagagagaggcaaatgcattgaatccagaagtaacataaaattagatcatgtttagttatgcccgaggtcacatggtgataaaaatgaggataaactgaaattgtctgtgagccagattagtttattttatgccagtcctaggaaaaagacacatcatggtaggatacatcctttttttttttaattatactttaagttttagggtacatgtgcacagtgtgcaagttagttacatatgtatacctgtgccatgttggagtgctgcacccattaactcttcatttaacattaggtatatctcctaatgctgtccctcccccctccccccaccccacaacagttcccagggtgtgatgttccccttcctgtgtccatgtgttctcattgttccattcccacctaagagtgagaacatgcgctgtttggttttttgtccttgcgatagtttactgagaatgatgtattccagtttcatccatgtccctacaaaggacatgaactcatcattttttctggctgcatagtattccatggtgtatatgtgccacattttcttaatccagtctatcattgttggacatttgggttggttccaagtctttgctattgtgaatagagccgcaataaacatatgtgtgcacgtgtctttatagcagcatgatttatagtcctttgggtatatacccagtaatgggatggctgggtcaaatggtatttctagttctaggcccctgaggaatcgccacactgccttccacaatgaacagacacttctcaaaagaagacatttatgcagccaaaaaacacatgaaaaaatgctcaccatcactggccatcagagacatgcaaatcaaaaccacaatgagataccatctcacaccagttagaatggcaatcattaaaaagtcaggaaacaacaggtgctggagaggatggggagaaataggaacacttttacactgttggtgggattgtaaactagtacattcttaacatcaatttattcctaaaagcaatgttcatagggcacactgtaggccatagatttgcctcacaaatttaaaggcctaagccctcaacatgcacagcagtatactcagagactatttgtaaagatgacgattctggaactttttaatgaccccaatcattagcaatgattaaaattaatattcaacattctatatttaccaaggcaataaagtagactaatctattttaaaagggttttaaaatgaagagatgaaacaaaccaaatgattttgatttaaacttcatgaaaacataagttgcattaatcaggtgattttgttttatgagcattctgattgaagtgatcatatttagccccgggagaataagagaaggtaaagtatgggtatggcactgaatttactgagatgattatattgtttgagttaaagaacttgtattaagaaacaagtatgtgccaaacattgtgctaggagcaagcaatgctaaaattacatgggtagaaagagagaatgaaatatctagaatgagttagaaacatcagtgttttccaatgtggagccctgacttcacatgaaaattctcattttcaaacaaggtagtttatgaaaactggactattagcaagacagggtgggcatgccatcagtatagtacctggtgtaaaactagaaattttaatcatttgtgctttcattttataatcagtaaaatccaaggtaggacaaacttttactttttctgtataatggactgatatttgaattatacccaactttaattttttgccagaaattatgctttattgtttctctaaaatggtactatagatctttatttatttctatatatttatatgatttttacatatatgtgcatttacatgtatatacatccataaactatatacatatatacacataaattacaaatatgtgtacctacgtacatatatatgcatatatcacgcaaatacaggcacattttcaatacccctttttgatttttttccttgaagagcatagcatctgaatttattatggatttatttttaatttatggtcatgttctttgagtgcttttggtgtttatctggttgccccaaactcgctagcattgtaaagaagatgtgcaaagcctgaatctagactgactttcatattgactttattagtcaaaaaaagtagatgaaaatgtaacagtccgtgttaaaaatgggaataagacagatgttcaagccctagcttcagcagtttttagctgagatttactggaagaaaacattttctgaactgtaaaacatgcaaaatgcctacgtgacagacttcattaacattattaaatgctatgatatagtaaaagaatttgtaaactgtcaagtgctttgtcaacattaggaatttagttattataggtatttccatatacatgttgtatttagaattccctttaattttatacttagggttgatttgtattttaactaagtcactttatatatctggtcccattatacaagtatacttttccttaggataagaaagtgatctttatatatgtttatcaacccaaatgcccatcagtgatggactggataaagaaaaggtggcacatacacaccatggaatactatgaatccataaaaaagaacgagttcatgtcctttgaagggacatggataaagctggaagccatcatcctcagcaaactaacacaggaatggaaaaacagacaccgcattttctcactcataattgggagttgagcaatgagaacacatggacaccgggaggggaacatcacacaccgaggcctgtcgcgaggtggggggcaaggggagggagagcattaggacaaatacctaatgcatgcggggcttaaaacctaaatgacgggttcataggtgcagcaaaccactatggcacatgtgtacctatgtaacaaatctgcacgttctgcacatgtttcccagaacttaaaatttaaaaaactttaaaaaaagaactgtagatactgatccaaaaaaaatgttcattaatgggggttaaatgattatttctaagtagactactcttgaacccttgaatctttaagaattttctttgctattgaagccattcaaactctattttattaaagctgtcgttattctagtagattttaaacagtaatacctgaatacattagaaatatgcaaatctgcattacatatggcatctgcagagcagaggagtttggtcatctggactcatgctaaagtctccgaaaaatccgcttgtcttaatgatggttgactcgctaatgctatgcgtatatagtcttattttaagtgattgaatgatgtggctaataacccctctgttagatgcactcagaacctcacctacctgggtcctcagctctccagtgaaatctctactttaagtttattttctaacatggtaagagccttcagtttatgttatgctcaggcccgtcactgtgaataaaatattagaaatggactttttttttttgtatttttttaatggatcccttggaactttaaaaaaattatttatttgagctttctactgttatcacagtgtctcctaagcatggcctcccgttttttgttggtaatataattcttacgttattcaaattagtaaccattatttttctcatggctagaattctggaaactattaggaaatcactgagcataattgaatggctgtttatttgaagagctatgtcaaggcagcatagagttgtattttcttgcaggggctctggagtcaaagagcctgggttcaaaccttggctccaccactttctatctgtggggcattgggcgtgttacatttgtgaaacttttgtttctccatttgtaaagtgaggtttgggggatgattaaaccagataactcatgtgaaatatttaatggaaatgtatttggtaggggatttattatttttaaatttggattgcacatgacacatgtcagggatcatgctatgcattttggatagaaagatggctaagatatcatgcctgactcttaaaaacttacctaatggtaaatgacgagttaatgggtgcagcacaccaacatggcacatgtatacgtgtgtaactaacctgcatgttgtgcacatgaaccctaaaacttaaagtataataaaaaaaaaaacttataatcaactgtagtagaaagagatctgaatggcttgccatttagctaggcacatggtatatgtgcttaattcatactagcagccactacagttgtcatgattaataatgagcttccaactgcacagaatgcttttaatccatagaaaatcaaatcagaaacaagtttttgtaaaattaatgtgaaaggagcaacaattaaaatgcaagattgacatttattttctaaattggttctattttctttcacatttacaaaatttataagaaaattctttatttctatgtgatataaagaactagaatgtactttgatgtgaattattgttgccagtgctgttcaacttttatccataatttactaagcacctacatttagacaaaggcattatccatccctttggggaggatttcagatgattcatacacagacctggtctcgaggaatttaagattttctttggggagggaaataaggactttaaccaactcaagagtacttagagaattttctgaaaataattttatcaatgaaaacttgttatattaaaagaaactgtcattctgacttccacaaatctaggcttgaaactatggataacgagatattttctattactctcactcacgtcattttcacaaagtgaaaaggtacattttaactagtgaaagaatagaggaaatggaagtagctcgaggcagtggacgatgattcaaaaagacagggccctattatttgatcaagttatgcaacgactctgggcctgtttcttcacctctggaaggaggaataatctccaagccctttcagactcttttggtaattcacctccagcacatcttctaaatgccagcattaactgtcctctgatttgtctcatgtttttctagccccatgctctcctgttcgccatttaccctcatgcaaggtacaaattacacccatcatcacaagacacttgctcaagtcccattgcccccttgaagacctgccacacctactctctcaaaaaccatcatttcctgaaagtcctatacagctcatttggtatttacagtgtactgccacaagccactaagcatcgttttgtgaatacatgacttacagacttagcttgagtaaagatacttgaaaatgaacaccatttcttggctatcttcctattttgatgtacccttcaggcctatgaattttagtataatagataaccaataattatttcttggttctttcctgcacatctgaataaccctatgcaaagtgatagaatgtttttctataaggaggtcctacactggagattgtgtatttcttaatgctgttgaaggaagagatgtgtatctaaaataaatagactctaacaaacattaatttatatttctattatctgttttgtgtattgagatatctcacaaaaataactaaacattttggcattattgatattacatatttgccatgaatatttgtaaatgaagaaaaatatatatacatcagtaattatcttggcaaactcttcaattatgcaatattgttacatagattacatatctaagtgaacactggagttttaacaatattgtgtgttcataaatgttttatttattattgccactaattcttattgccatttcaagaactatgtataagttgttctaaaaactattaaagtataggtgaccatggtcactactgcctactttggtaaaggccaaatatgtgaagactttttaatgtgttaacaaacgttgaaggttttttaacctgttaacaatcagtaggactcttgaaattatttcctaagagagtaaattttacaacttgcaaagcatgattaacctcttgtaattataaaccatctcttgtagttatgtagcattttgttaatgagcaaagaaccattgtggttcctttttacatttcttaaaataattctccgtaacctcattgatatctccagtaaatttagataagcttttttttttaaaggagggttaaaatgacattttaaactaatttttcttgttagttatacagagttgaactatctgagggttttattgacagtcataaaaaatttgttattttctgtgaaatatagagaatttaattcattatcatattattaattctgtgggccattgtcttaattctagaggcacaagctgttttcatcccactgaaatagaggaatcaaagtatgttccttgctcaaagcacaaaagtgacatactacatagtatgcttcttgagtagtcgtaaatctcatgtgttaaattacatcccaaagatttcagtatgttttatgactttaataatttatggtaatttctaatctggcctttgttgacctgtcttgctttttaaatttttagtttttcgacaaaataattaacatattttaataatcttccaaaggtgtttaaaatggcattgtatagagatagctgaaggcttttgagcttctgtgttgtaaacactttcttaataaaacatgaattgctaccagatgatccagcaatcccactactgggcatttatccaaagaaaaggaaatcagtatctttgaagagatagctttgttcccatgtttactgcagcacttttcatactagccatgatatggaatcaacctaaacgtccatcagtggatgaattgaaaagaaaatgtggtatgaaacagaaattgctgctttaatttatattaaacacactcatattcttctcagctgttaagtattgagttatagatttaaagaattctattgtgaagactaaagtgactattaaagtaagaaattattttttccattatatttaacttatttcatactttaatgttagcgccaatgagcaagactattgaatacaaaaactaattaagtagtggtgatagtacagtatataagggagaacattcttttagaaaggaacaataacagggagcaatagaaacaatgaatgagtgtaaggtcacttagtgttaaaacagctaaaatatagtacaaataagttgcgttttaatagtgattttatataattacaccttgatgttttatttgttacaagaattgtccaggaagatttctctaaagaccaaaggcactcttcccctaaataactccaaagccagtcctgtgtttctataaaaaaaaaaaaaaaaaaaaaaaaaaaaaaaaagtgaaaataacgtgatgaacatttttgaggaagtataaaaccaaaatactccactgcatagctgtttctgcaggtattgtattgatatattacattattcagctttggagtctccacatccaatgttacatcatcactctaaattaaacatgtatagataaatgaaataaatgagatagcatatgaaaatctcatagcccagcccctgcactatttaaaatagaaataccaaagaattgtattcctcatctgaaagctatttagtggtggtgtttcaaataaaaattccatctactgctgttgcttccattgtatctttttctctgcggtactgaaagagaaagagacccagaaggggccttgtctgaagtgtccctcttttaagctgttgctgctttaagcacagggtggacaaatgtaataggagtttcataaaggtggaataaaccagcggattacggtgtgggtgaatactttcagatgttaaccaggagctctgcttgcatgctgggagttgcccatgcctcttctagattgaggcacattatcatgcacaacctaactccaagaaatcttttaaaccactggaaattgaacccagaacatgtctctaagccagccttttcatcctgacaccgaatcatagcatgagccagtctgtcagggatgctgctgctctctaggcaaattttaaatgttgaaataatgaatcatgttttcttgaaaaccatgtacaccaaagaaaagttagtcattttatagatgatgaatattaacattttcttagacaatctgataaattatcagatctcacttttggctctttttaagacagttatgcctcagaaatattaataaacccccaagcccttatactgatcagtatgttcactactagctatgagaaattcttgaagttcttgtaattattgtattatttccttactttcattttattagtatgtgaataatatttttaaaaattctagtgtatgtcttgtatatattttaacaacatgacttttaattaatgtcttgataacatttcttctagtgtatgttttcagtaacatgattattaactgtaactttaaaaacctgtggattagatgggaccattttaaaatgttttaaacctggaaaatctgatggctttaggtttagttcaagctatagatcacctgtggagaatggaactgccaaaaaaaaaaatagctgtagcagccctttgagtattctaaaatagggatgttatccagagcattggtttctaaagcttccattatttattgatgttgagctttcaggatttagctacaatatttactcaacatctaagccatgcttttttatcagtcatgttttatatcttttataatcaaactgcttatcactgaaaaaaatatataagtttctatgtatctggaagaattctctggtgtttcttagatatggattttgatgtgtggaataagaattcaattcaaggataacagagatgttgtcctgaaaaaaatcgaagaaaatcagcttttctttaacattctgtcaaagctcctgactattagtttatcagcactgttttgccaaaggtgtcttctcttctcttctttgaaaaaaatcatctgctgctgctacgccgcaagtgtgttcccgctgtgcctgagaagatgtgtggcataaaaaaatgggcatggcctgagttaaaagtgctacatttaagccagagctggcttatttattagttgtctaatcataggaaaatgacagagcatgcttttctcttgcaatatccgttgctgaaaattaaacacatgagcagagctttcagagaggttgactggcctctcagacagcacctcataggatggcctgtgttgaagcatctcctttaaccagggtctgtccctcagcattgggttggctcacctagattggattgtcccagcagaaaaaaaaaacccaaaattcagaatcatatccaaaccggaatactctttcattcacattacttgtactaccttttcagaaactggatacctgagtgtgtgagggtaacttagaaacttatctcatggttagaagttttagaattagagagcgatgatcatgaaacggacttcatgatcagaagcaatggagcaaggaatgagatgtctttgaggagtatttccctgaggctgtggataacgctgacgaataatccccaccttaaaagtgggttgaccactctagtagctgtaaggtgggagggttctttcttcagagataaatctgtgctcttcacttgcccatttcccaggttttcatgtaggtagaagaaacacctgtaatctgaagacactcttccttcagctttgttagtgacagggatttaaatatgtctttcacacattttccttagatagttaaatttcacttttcctgtttgtttttctctgaaggtattctaactcccctcctaatggacttctagagctttctaattctatgcaatttctgttgatttgttctggtaaactttgaaggtaatctctgattcaacttcttggagattctatcatgtcatctctgtttattaactttatgttactcatggtttcttgatgaggactcattaaacataatgtaagtagaaaattattaactacataatatttactacgggttgttatttctgatagtagctagctgtaagattccaattgttcttcaaatctttgtctcagtgatctctgtgtagttcttgactacttcaaataacttcctagaaggatagggatttaataatctcttaataggaacacttaacacactgctggtgggaacgtaaattagttcggtcgttgaaagcagtgtggtgatttctcaaataacttacaaaagaattaccatttgacccagcaatcccattattgggcatatacccagaggaatagaaatcattctaccataaagacatatgcacgttgtgtatgttcattgcaacactactcacaatagcaaagacatggattcaacttaaatgcctatcaatgaacagactgaataaagaaaatgtggtacatatacaccatggaatactatgtggccatgaaaaagaatgagatcatgtcctttgcagcgacatggatggagccagtggccattatccttagcaaacttatatggaaacagaaaaccaaatactgcgtgttctcacttataaatggaagctaaatgatgagaacatatggacacaaagaggggaataacacacactggggcctactggagggtggaacacaagtggagggagaagatcaggaaaaataattattgggtactatgtttagtacctgcgtgagaaaataatctttacaccaaacccccgcaaaatgcagttcacctgtatagcaaacctgcacgtgtacccctgaacctaatttaaaagttataaaataaacgtatcttattttcagtacaatacaccacagagtagaagggttaaaagagattgcttctgaggaggtgagatgggggtaaggacagcacaagagcattttggggggtgatgaagctgttctgtgtcttgcctgcgatgatggctacacgactaagcccttgtcagaactcacagaactttacttcaaaaggagcggattttactacacatcaattccaataacaaatactttgtctttaagcaaagggatacctaaatatagcgtattgaatggatctccagaaaaacacatttttcagttcatgtttcagcctaggcctcatctcatccaggaaaccttgtcttgcttgcctttacatacatgtggcaatcagtagtttcttttagggctcggactgaacactcaatgaacttcaatcttagcgcttgtcgtagcagattgacatggtttatttatatgtgtcattctctgtagtaaaaggaaaggatcaaggccattcacttttgtagtgattgtgcatggcagtatttggcacatagtagattattaattatggaacttctgttttcacacacacacacacacacacacacacacacacttcagagctattttcatttaaatatttgctttagtctccaaagcccctctgcctcaacaccaacccttctatctcattattcatcagcttttctcctattacgaaactacttaggaaagcccacttatttagcttatgatggcaaaaataaatatttgtacttttttttttttttttagtcatcgcttcatagaacagcctctgtcctctgcttatgccatgtctgaatatatgctggaggtaaaaagagttcctggttgagagcttcaatttgagaaactatctgagattactttccaggttccaccgtggaacctgtctgaccttgaacaaatgacctcgaacaagtggctgaaatctcttctatttcgtcaactgtaaaatgggggaaaaccatgtctatctcatggggttcatgtgaaggttaagaaattgcttattcagtgtttagcacagtgcctgatatgcataaagctcctaggaatattagctgttattgtatttccttaaagaagcccatagctctatatgccctttcattatatgttttagtagcccaatttaacatatggataaaatatttttaagttaaatgatttgctaatggattgttgaacgagtggcagacacccatattatagacgaaggtcaagtccataacatacagtacatttccccactttcatttcccattaccaaaattcattattctcctgagaaactcattatagaattcatgtcagattcatctgtgtgttcccagcagtgccttatatccagaaataacactgagtcattgtctagatgtagcagaggtggaatcctccaaagagaagcctcagagtggccaggtttgccaagtatagggatgccttgattactggccttactctttatgctcgtgaattcctaagttttattcctcctgtagtcatagattggcttttaagctacaagctgaagagagagaaaacctcttccacctcgttggaatatgtctcttcaatccatttgagccaatttaggacatgagactgctcttagtctagaaccagtcatcaggagaattccaggtctgattgactcggactagcgggtcaatatcagggcaaaaattccaacgcacaacacgatgtatcagtaaggagaacctcaaaattatttcttaacgtccagatcatgttcctatttttatatatctattttctcacataagtcattaaaatgatgtacctgtgcgggtcctttaatgatactcaaagatcttgaattataggctaataactaacttaataagctgcagaaattaacatttctgctacgtttatgtagcattttcccacatgtacttcagaggcttgagaaaagaccctgaaataatgactgaataacagctttactcacttaatttcaaatttgttaattcttctgggaaataccgtcaacatccattttattatttttctcaattacatgtacgtttctacatcagtggataagttaaggagaagaattccctcatgataattttttcatgctcgaaaattttgaatcaattttttattttacattatactctttcctagtcattagaaagggagtggtggttaagataggcaagaatgctttataaggatactactctcgtttcaattcttaacatcaaaaaccttaacagtgtgtagactataaaataaaatatctagggatcagagcattgtgctgaactttgcaggttttttagtcaataatatatatgacgtgttcacagaattctttgtcaacaaagtacttttggagctccaggccatttaagttggtttttgtactttttctttttcttcggaagactttttttgttctatttacctggaagtgtttcttttttggtactgtgaattaaaatgagaccaatctactaggcaggaaaaaaccttaattagattgttgacacagacaaataagaatgtcaattagcatctactgtcacatgcctctccagactgcttctaggatgagtggcctcaagcagctacatcatctttatactcctaaagcatcaaggaaacttggagtgacaattcatatcatgaacacatccacagtgatgatgattgtgcttcttcccccccacccaacaacaaaggatgaatgccaattaatgtattcagttttttgcgtcaaaggctggatcacttgtgcaatgagggtaatcatcctgaccagacaggccatacaatccatattgtgtgaattaaagataatatgcgtgaaacaccttactctggatgtggttcatagcagtagcaaaaagatgaaaactatggtatgctaacattttagagatctgtactctattttaaataattttataaaagtgcatatacaataaaaagtgcacgtatcacaagtatatgcctcaaaatctaaagccagtcatgtaatcagcatccacttcaagaaagaaaacaaaacagtacccctggttcctctttgcaatcattagtctcccaagagtaatcaccgatctgatctgtgacagcatagattggttttgccctactatatttttgctgaattatacaatatatgctctttaatgtctggcttcttagtgcattgtatttgtgtatcagctattctcttgtgtgtagttattaaacaatcattttatgggctgcataatattccatagggtaaatataacagttttattgataacttagctattacaaatagtgctgttgcagacatatattctattacatgtcttttggtataagaatttacacatttcacatgggtgtatacccagaactgagattgctaaatattggggcacattgtatacattttgatttagtagataagatattgccagatatcgtaaatgcacagtttgataaatatagagatttatactttttctagagaaaagccatcaatatcagtgtatgtgtatatatatacgcgtgtgtatatatacgtatatatatacgcgtgtgtatatatacgtatatatacacacatatatatacgtatatatgtgtatatatatacgtatatatatacacatatatacatatatgtgtgtgtgtatatatatatatgaaacaactcagaagcagaaagataccccatgttctcacttataagtgaaagacaaataatgtataaacatgtacacatggacatagagtgtgtagtgataagcattggagactgaagtgtgggggtgtgcaagggaatcagtgataaattaatggctacaatgtacataatttgggtgatggatacactaaaaatccaaagttcaccactatccaacatactcacataataaaattgcacttgtaccccttacattcatacaaataaaaaattatttaaataaaaataaatatgtgtatatgtatgcatacatacatatgcatatacatatgtgtttgtgtgtgtgtatataacttacacttaaaataagcatggatgctgcaatgaatgctcaatttacaagggttgtccatccaaacttgtggcaagtatctcacctctcaagttgttttcttttttcttcatatatttcttgcttttgtctaggaaggaataatttggcttgcctttcaagagtgtacagtcagcatgataacccaaacacttaagacacgtgctaacccatgtggatcccttgagagaaggaaaacagtggtccttttactgggcagatagagcccggggccaggtttcgtggcttgaagatttcagcttctctgcgcctctcagctcagtgcctctggaagcaatttacaacttgtgaggccatactcaaaggccctgttattaattccccgccttccgagaccccatttcagaggatctcaattgctctcagagtgaatttactgtttcctgaattccgtaatcccaatagcaggtctgttgtcctcattagatagcttaagttagagtcggcagtgtaattggcaactgagctactaagtatccaatgcttatgtggaaaatatgttccctattgcaaacaactgatattcatattcaatttggcaccatcatctatctataaagcagatactacttgtgtttattaagttttatcccaaataattattttagtaataatgcttgaaaataggccttggtcatttgcatgtctgtatatggcatatcctgagtctttgtatgtattagaaagatcactcgttttgacttgatggtttaataaaagatgtccctcactttgggcagagacatttgaaaaaggcactccaaccagggacctaagaggtgaatgagatgcagctctgaatcaggtcacacggcctcaggaaggaaacatcttggttttcacatccctcacttctcgatgtcatgtgcaatacacaaatgacccctcaacacacacacaggcacatacacaaacacacactcactcactcactgtattgtctctttccttgactaagtccttcttactaactcaagctctaaagcttttttacttacctaaggtgagtgtgtgaggatttgaggtttcaatattaaaattcagaaacatttaaagttcattttaaatattagtaaaaaaaaatcttgacaaaatacaattatagacaaaaagaaaattcagaatatttggaatttaaggttgaggttacagccctatttatgaaatattagaagaaaaatgctggagagaataaagcaggtttatgagtctgatagaaagcataaccagatgattatgcatatatttgcatatgcaaagctttctaggcaatctgaacatttaaacctacaaatgtggctgcgatgaacagccacagaagagcaggctagaacagaagaggaggctagaacagaagagcaggcagaagttgtaaatgaaatgttaattttcaatggttgatctcccaagtactggaacagatttgtgctgttttcaaggttttggttcaaagaatccagtagtgtattgaattgttttgtggcacttccctgttattttgctttgtaagctacctcaatccatgaagtggctatgagccccttatacaacactgttgatttttttttccttatctacgcaaaagatttttgattcagggccaggcatggtggctcacgcctgtaatcccagcactttgggaggccgaggcaggcggatcatgaggtcaggagatagagaccatcctggctaacacggtgaaaacccacctctactacaaatacaaaaaatcagccgggcgtagtggcatgtgccggtagtcccagctactcgggaggctgaggcaggagaatcacttgaacccggtagccgagatcctgccactccactccagcctgggcgacagagccagactccatctcaaaaaaagaaaaaaaaaaaagattttttattcaggtggctatcagactcattaaatagaagccttaggttaagttcacgggttgctagttggaagcctccatggactatgttcataaaataatagaaaggagttatgcaggacttcttgaaatgttatttaaaaagtcagaataggctttctattacttgtctgaggtcaaatacatgtagtgctttctgaccatttcatccagggtgttagctaggacaataagaggtgcttaaaaattattagattgagtaaatgagaaagcccttagaaacataggaacagaatgacccttgctttggatctaatattgactcccacgcctaaatccctttggagaactcctttattttctcttccatcaagagcaggtataaattaaaaacaccattaaaggggccatctagctcagctgaagctttcatcacacatgtaggggaggtatggttgggagggatctttttatcctttaggtcttcaatttacataggacttttgaataatcaaatagccccaaagagctgatcttaggactagttgtaattgagactatttctccatggggtagaaaaatctagttgtaggaaaactgagaagtagatgtatgttaacctcaaaggctgttttttacaaaggatgttaaagcatcatctttgctcagaaagggagcaataaaacaaatgagtggaaataacaaaaggaaataatggccaggtgcagtgcctcacactagtaatcccaacactggggggctgtggtgtaaggatcgcttgaggctagcagttcaagaccagcctgagtaaaataggcctcatctctacaaaatagatagatagatagatagatagatagatagatagatagatagatagccgggcgaggtagtgtgcccctgtagccccagctactcaggaggctgagatgggagaatcgtttgagcccatgaggtcaagtctatggtgagctgtgctccctcctgccactgcactccagcctgggtgacagagtgagatcctgtctcgaaaacaaaaggcatactttttagatgtaatggaatagagtacttccaaacctggctgcctgctggagttgtattggaagaggttgcacgacttcagtggagatggcctagatgcctgctcagcagtcatctagttaaagcaactaagaacatgtaatatgaaactgcaaaaagagatcgtgtacgtaaaatcactctgggctcctcagatagagtaataaacacaactcctgacagccaaataaaaagagaaataatacagcccttgacttccttggttgctttgacatactaagtaggtgttacaggttgggttctctgggaaacagactctaaaacatttttatttttactttatttgttgttattattattattattattattttagacagaattttgctctcgttgtccatgttggagtgtaatggcacaatctcgtctcactgtaatttccgccttatgggttcaagtgattcttctgcctcaaactcccaagtatctgggattacaggcaagtactaccacgcctggctaattttgtatttttagtagagacggggtttcatcatgttggtcaggctggtctcaaacacccgacctcaggtgatccacccacttctgcctcccaaagtgctgggattacaggcgtgagccactacgcccggccagactctaaaataaagtttaatatgcagaatacttatcagggaatgcccactggaccaatacatattcaagagagggcttagaagcaggattggacagaaagagaagttgagctgtaatgcaggcccaataacagccttagtgttaagcaggctgagagattcagcagttaatgagacagtcaacccaaacagttttataggcatcaaaagtatgatcagcatggtgtcagtttcctgtgtcacttgtcccacagtatgataccaaaattaaagagaccagatgacatgcaacacaagcagtgtgcactctgttgttgagaagccaatttcgtcatgcaattaagcagttttatactctgcagctgtactttaaggggagctgagatggaacatcatatgtctcaccataaccagaaaggcagatgagaaatgttctatcgccacctcccacaaggtaagggacttccctaaagatacagaggtgggtggaatattgccttggtagacttcctctcaagactgcctatcttcccatgttggaaggatcacagagcatttgtcaagacgtgggtcaatctgcagttgaactttgtgtatgtggcctatgtggatacttataatatcattgggcacctccatagagctgtttcccaattgaccaaacatatgggaagcttcagagcttcgaatgacccttcagagtagtcctgagaacagtgagccttactactcctgcattaatcagtcattggatgatagccttctcagaaataagtcatgaccttgtgcaagggggctcttcatggctgggaccacccctaaaactgagagctgaaggctgtctgccaccagcccttccacctgctgggacaagttctttattgaagggaaatctgagtagttcatcagcgtccatcacagtagtcaagccgttcattcttccttcttatgacaacattgtgcttattgttatgtaatccctttccagaacattttaggttaagttttaaaaataatgcatataaatagacaattcaaatactggggaaaaaaagcttgcacttatattgttatagaaatgtgcacacttaaagagctgatttcttctgggtatttacataactttatttaaaaatccatccatttttaattagctgtttttaatatgcagttagctaagatattataagccatatattaggctaatggacatttaacagcttagttaagttcttttaatggaaatgctgacaaacctttgtctgtaattatagcaacactgtgattacagaaggaggtgcctctccttgttgtttgcagccctaaaattccatgtggctataagtaacaaagtccattattagataaacacaagtcatacttggcattacttgcattactcgtctccttgctttatttgaatcattttttaaagttgtaaaatgtttttcaaaactcagaatagtggccagttaataatatgattcctcttatattatgagattttaaaaaatagttcaccagtttctggtggcctctatacccattggcaagtcctagccattgtgaattaagtaaacaattctttatggaaattttttaatccttaaaccctataagtttttattcatcatgtcaggtcacttgtcaaagggtttaacattcagaattcaacaaaagtttatcaaacacctattacaggacgtgcaattttgggcgcactgggatttcagcaattaacaatcaagatatgatttgtatcgacatggatattacattctctcacaggagacagaaaacaaaataactagaaaatatacataaagagactttaaaatggggtaaaattacagattgtgacaggatgaccactttggttcagaatatctaggacatttttttctttttttttcccctccctccctctttcttttttttctttttctttttctttcttttctttctttttctttctgcctttcggagtcttgctctgttgcccaggctggagcgcagtggtgcaatctcagctcactgcaacctctgcctcccatgttcaagcttttcgtgtgcctccgcctcccaaataactgggactagaggcatgcaccaccaggcccagctgatttttgtatttttagtagagatggggtttgaccatgttgcccaggctggtctcaaacttctgacctcaagcgatccacccgcctcagcctcccaaagtgctgggatttacaggcgtgacccaccaggcccaagcaaggacatttttttctgagccatgttatttaaacagagatctgaatgacaagaaggggccagctctgtgatgtaggggaagaaaaatatgttccttctacccttctaggctgcccagctggagtcctacaaagttagagtgacaaaagacagattaacaagaggaaaagcctagaagtttattaaaatattcagtgcacatacacctggtagaaactcagtgatgagtaactcaaaggggtggttagaatgttgggtttatatagcatctgaacaaagaacagtaaacttgtagagaaatgacaaaacaaagaaaaaaggggtttaggtatttagggttgccaaactgtaggaaggtaaatatatgggagaaacatggagtatagtttgtttatgccaagtctatcttgagatcaacttttcgtattcttcatggccataacaatttcccaggagagagggcttatagcagttatcatttctcagaagtttctgcttttatttagacaagggaagcactgggaaggcttctttttgcttatattgattcttacttgcctctaactaaaagtaatctttatgtcaaagtgccatattttggagtggtatatattgatctcctataataacaatcaaaaggaacagtattctaggcaggagtaccactaatgcatagtgtttggtgtaaagacaagttaacatattcatggggcaacaacaacaataagccaatatggctaagacattgaggatgagtgagttggagaagtaggcaatggccagctcatataaagacttgttcgtttttataaattgtttagattttattgtaattatggtggcaagtgattggagagtattagcttcactttgactggcttatcgaaaacggaatgtagggggtgaaagtggaataaaaagaccagtcattaattgagtagtccgtgtgagagatgatagtggcttggacaaggacgattgtactggagagattgaagcgactgatttcagatttgtagtcaacaaggcttaattggtaggagaaaaaaataaatcagtgttaactctttaatgtttaacttgaataattatgatgagggtattaccatttattgagatgtagaatattataaagtaagagcagatttgttcaaaaagtatcaagaatctttatttggacatgctagtttggggatgcttattagagaccctaggaaactgaatataaatgtggattttagagaagagcttagggctggcagatgcacattaaggatctgtctagagccatggcgctagagacctccaggagaacataaatagtctcaagatcaagccctgagacactcagatgtttagaagtggaacagaagagggacatccaatatagaataccaagaattaggaggggaatcaagagagtgtggcaatatgaaagatacaaaaagagtgttgaagggagggagtaattaataaccagcatgttatgaggggctcagtataatgaaaagataagtgactattggatttggcaacatataattttttggtgatctggacaagagcaatttgaacagaatgatggatatggaaggtccagaggagtaggctgagtaaataatataaggtgggaaaatagatacaaagattatagacaactttttcaagaagttttactgtgaaggggcacagcaagctgagacagtgaggataaataatagactcaaggatggtaactttagaataagaaatttcaatctgatgggatttaagtgttagcaaggaagctttaagaagttattttccccattagaatgatctgaaaaatgttttagaacattcctcttatattctattttatcacatttatataactttcagagaattgaaagaggtattaagttattatgaaattttctgagattaataagataacaattataggatgttttcttttagttgaaatacacctactcagcctaatttttataacttcttactgaagtataatatacttcagtagaaaagcatgcctaatataaaggtgcagctagatgaatttgcacaaactgaacacatccctttaaccagcacttagattaaaaacagaaccttgatgatacctcagaggcccccttctgccccttttcagtctctccgtgctacccccatggataagcattatcgtgatttctaataccatagattaattttgccagtttttgaattttatgcaaatggatctatttcacctaattgtaaatatataacattgtcatagcaaggcactcattgccttacactgaaaattacattgactctttgccacaagcttagacttgctttctcattttattatcatcaagcctatagctttcacactataccttgttcctgctcttccctactctatttcttggtagatattctatatcagtcttagagtgcagtttgcagaacccctccatcagaatctcctagggagcttgttaataatgcagattcctaggcccctcccatggtttatgaatctgagagtgaggcagacaagactataccctctcatgcctctataatgtaataatgtcttcctagaatgttctttgctgcatctcttattaaagaaatcttatgggccgggcagggtggctcacgcctgtaatcccagcactttgggagcctgaggcgggcggatcacatggtcaagagatcgagaccatcctggctaacacggtgaaaccccatctctactaaaaatataaaaaattagccgggcgtgctggcaggcgcctgtagtcccagctactcgggaggctgaggcaggaaaatggtgtgaacccgggaggtggagcttgcagtgagctgagatcacgacactccactccagcctgggtgacagagcgagactctgtctcaaaaaaaaaaaaaagaaagaaagaaaaaaagaagtcttatgtttcctttatggccagagcacaacattgtcatgaagtcatctaaaatttcccactagaggtaacatctccttcccctgtctagctcttttaaagcattacctccatttgccttgtatcatagctgcttgtacacctgtctgtctttccgctgaggttataatcctctggagggtcatgactttgcattcctttgtgtctcccattagcagccagcacagtgccttgcatactgttagttctaaataacttctctctctctctctctctctttttttttttttttttttttttttttttttttttgagacagagtctcgttctgtcacccaggctggagtgcagtgcaatggcatggtcacagctcactgcaacctccccatcgtgggctcaaatgattctcctgcctctgtcttccagtagctgggattataagtgtctgccaccacgcctggctaatttttgtatctttagtggagacggggtttcaccatgttgcccaggctggtctcgaactcctggtctcaagcagtctgccctactcggcctcccaaagtgctgagattacaggcgtcagctgctgcgcgcatccctaaataaacttttttttttttggcatgaaatctgtaacactggaaagatgttattgccttagaataattaagagattaaatgtagaatctcaaaaacattcatttttttccatgaaaactttaccaggcctcaagggataggaaaattatgggtacagaattgagaatctgtaggaacttgcaagataaacaacggtttcacaagaaagaccttgttggagagttaaattttcagacagttgtaataacttcacattaaagttttgtcaaaaaataagtatctgcatgttttgtttgccttccaatgccctcattttatttgattttttcccataagtaactatagtgaaagcacgaaaatgtgtttctgtgtttgtgtgcctgtatgttaattgtgactgtttctattgcattgttattgcagaacctaggcacgcactctgtaggcttgggtgctttctccaactgaaaaaaatcctacatatggataaattatttttacagccagtgtttaattttacaagtggtccccctccttctgtttttaggatggcagagagaatacatatttacttaccattatcacttactcatgctttgagcttgaaggaaatgagacagaaaaatgaagtaacattaacttctctctggaactatgtttctcatattagagctttatctgaggagttcacttcctctctcttcaatgctttgttcctctccagtcgattcaaatgtcctcttaaagcagaagttccgaacctctttctgtgacttcaggagagcatgagaatgtaaatataagttttaggactaaattttcaaagactttttccactcagctctcttttcctcttcggtttgttgttgtcgttgttgttgttgtcgttgttgttgttgctgctgctgctgctgtttttccccttccacttccgtaactgagctcttagggtccatctggaatctgattgcaattaaaaaaaaaaaagtttatttttacctccttgtacgtgctttctcctaaagcaggagtcagaagccttttttctttgaagggctagttagtaaatattttaggcttgtcgtctttgtcgcaattactcaactacgctgttgtagtatgaaagcagacaatacatacctgaatgagcatggttttgttcctagcaaactttacgcacagagaaatttggatatcgtataatttttatgtgttgcaaagttgtattattcttttgatttctccccaaccatttaatatgtaaatcccattcttagcttgtgtgccatacgcacacaggcagcaaatgcgagttgtcacacaggctatagtttctgactttatgtcttaaagtaaacagtaataatcattctctttttccaaacagtccactaatctccctttgtattcagcccttgcatagtaaacgccgtttcttcatcatcctgatttttattctgagaaaatactgtatattgttcccatgcactagggttcggggaaatttaaaaggatgtaggatctccttttcattggtcctaaaattgcactggggaggcaggtcatgtttatgaacagataaatagtatcataatataatcatgcatttctatggctagcatttagaactatagcttttgatgtcatgtggtttttatatggttgattatttttttcttatttataaaatgaaaaagtttgagaatttttcatctccttaatgtattcccttatttgagggaaaagtatttacctactacataggaatttatcttaaaattttctttgtctatctatttttatggaatataatcgagcaactattttactaattaatactttaatatcattatgaaaatgttctcatatttttaaccttataagatcagataattgctatgccaatctatggttgaaatgggttcttatacttaacgctatgctctttcttctgagatgtaaaaatatgtttaaatcagaatttatataggtgtcaattcaaaatgacagtagttcattattttgattagtataaatgttcacaactaattctattctcttatctattaagtcaccaaataaagtatatttgttttaaatatttaacagtttaaattattctttgaaaacttatgagtctaaagtaagaacaattaacccattcattttgcaagtgggatagttgaattttacttgcaatccagggatttttgacagtttgaaatatacatacataccatgtatgtttaggaaaacatttaaaaagagggggttgtaaaataataatagttcttccatgattttttagccataatgtttataatataaaatatgtatactcttgttattgaatgtagtatgtttctaatttaccagaaggcaagagaataatcctggagaatttctcaaggcatcttcgaactctttgatttattgctcacatatagtaatttgccaaatgacgccctagtgaactgaaagaattaatgccccgtcctaagtcactttcaccgagggactgaaaacctgcagcattttgccaattagaggaggaaacaatctaccttgcagagtcaggagtactggataaaggagctaagagtgttgctttttttccccttcttactttaaaaatcccaattcatcccatgtctttcttaaaggctaagtgaagtagtaagtacgtttttgcaacatacgaatttagcagactggccttgtgtttatttttggccggaaccattacacttatttccaaccctctcctttatttgttggttgataatgggctaattttgaatctttactgtcaaaagaacattaagagaagcagccctgcctgcatcgcaggctatgtctgtcctttgccgagtattaaacactaaaaaaaaattaagaaaatactaacaaaatgacaaagcattaagaaaataaaactagatgttaaaggaaatgagaaaataggaaaggatgctgtacctggagtgattttttttccccaggctacctaagatgatcaaaaaagagctaatttctcttaggtttctattaaggaattactagaatatcgggcacaccaggaaactttatcagtggacctgtcctgaaccaaattttcttaatgtatatatgataatttgttaccacatcccagattattttacaggaattaaaatatatttgaaacactgacagggaaaattgggtaagacattgatagatactacaatctgtacttgaaactgcactcaaggaattcgttagtcaagaaagaacacaatgactgtgggcccctctgggttttggaacctcttttgtaaagcatttttttttttcccaaatagaagatattatttttgaaaaggttaaataaaaaatctttgttcactatatagtttcctcctaaggagtaaattaatttatataaaatattgcaatataaataacaattttaaaatctcaaaagagcagtgttttaaaaataatgtagaaacattaagaaatgacttcaaatgataagaatgtcattggagagcaaagggtttttaatattacatatcgtggcacgtatatcagcacccaaccgctcaagatacagagttctttacaaaaatcaaacagaaggaaatgtgccaccttgttcataaactatatttaataataagccaggcagataaagtcactttcacaaataatgagcaagcccatggtaatataattcatttacaataagatttatctcatggaattcttagactgtgctttgaaatttaaataattctgataaatgccaacagaatagagaaatcaattccagagcaattactaacacgttgcattacctttctaacattaatatttctcttcatacatatcattgaagagaaaatgaggatggaaaataaaaagatcaggtaatatatttgctttctcatctagggttgttatgatcttcaagatgaagttttattttttactcctagcaaatgatattcttttttattttagtttttattattttatttttctgtaaattattggggtacaggtggtatttggttacatgagtaagttcttttttttgatatttctgagattttttttttattctactttaagttttagggtacatgtgcacaacgtgcaggtttgttacgtatgtatacatgtgccatgttggtgtgctgcacccattaactcgtcatttagcattaggtatatctcctaatgctatccctcccccctccccccaccccacaacaggccccggtgtgtgatgttccccttcctgtgtccatgtgttctcattgttcaattcccacctatgagcgagaacatgcggtgtttggttttttgtccttgcgatagtttgctgagaaaaccacgaggtaccatctcacgccagttagaatggcgatcattaaaaatcaggaaacaacaggtgctggtgaggatgtggagaaacaggaacacttttacactgttggtgggactgtaaactagttcaaccattgtggaagtcagtgtggcgattcctcaggcatctagaactagaattaccatttgacccagccatcccattactgggtatatacccaaaggattataaatcatgctgctgtaaagacacatgcacatgtatgtttattgcggcactattcacaatagcaaagacttggaaccaacccaaatgtccgacaatgatagactggattaagaaaatgtggcacatatacaccatggaatactgtgcagccataaaaaaggatgagttcacgtcctttgtagggacatggatgaagctggaaaccatcattctcagcaaactattgcaatgagtaagttctttagtggtaatttgtgagatcctggtgcacccatcacacgagtagtatacactgcaccatatatgttatcttttgtccctcggcaccccttttctaccccccaagtctccaaagcccattgtatcattcttatgcctttgcatcctcatagcttagctcccacgtatcagtgagaacatatgctgtttggttttccattcctgagttacttcacttacaatgatagtctccaatcgcatccaggtcattgcaaatgctgttaattcattcctttttatggctgagtagtattcatatatatatatatagacacacgtacatacatatgtatatataccgcagtttctttatctacttgtcgattgatgggcatttgggttgatacttgcacacacatgtttatagcagcataattcacaattgcaagtgatattctcaggaagcatgatgtaagtgacagagacttactttgtagactgcactcattcacttgttctctgaatgtgctctaggcagcctgagtttctactatgtcagtgttacatagatgagaaaccccatgggtggtttccacagaggctgcaatactatttttgataccaaaaatctgtttggttttgtgagccccagatgcccatatggaaaactgaagtgttgatacctctttgtagccctctgatgaactgcatggttcaccttcctcagcagtttgagcggggtggggagagcgcctgcttcctagccatccgattggcctgaatcatcaaaaatgctatcatgaaacaggttctgtttatctgctccagattacacccatcatgttctagagtgctggtttcatgcttgaatctagatcaagcctgctttcctcccctgcctgtactccctgtggctacctacagtcctgctgctgacagataatctaaaccaatagcacctaattagcctatttgctcatgtgttttttccatcgtggtataatgtcctccttgtcaatttagggtgaaaatgtagcaacacgttgctgatggtttaatttctggaatgcaggtaatgaatgtgtttttgcttatccaagtcttcccatcagatgtcaaatatagaagaacagtgttcagaggtcctaaatttaaattggagtgagaaattcacagcgcccctgaactcaggcaaaatgcactctgacaagtcaaccagatattcacagatggtctggaggatttgaagcctaatttggtgaaataaaattaaatgagtgaaattgtatgcagtcattaatctatcaccatacttaaaatgcttcattgaaatttcttttactgcttcaaatgaaaaaagatcaaactatgttatagaaaagcattcaaaacccttacataacatagataaaacttggttggagacttacagaactttctctgctgcttcgagaaagttacagtgcccacaaatctattgctattagaatattttattgtattcaacactcaattctaccataattatgtatatgagaaaaatatttttacctataaaataattattattaccttttaaaaatctgacattcttccttttttctaaagaaacatatttagatttagcttttattttatttttgtgttgatacatagagattgtacatatttctaagattctagtgatattttgatacaagcgtataatgtgtaatgatcaaatcagggtaattgggatatccaccatctgaaacacttatcatttcttcttttcaatgccatcataccaaaaggaagtaaatagaatttcaaatataaggacagccatgattttacatacatgcctacgattccaccacaaaccataattacgtcccccaaacttttaacatttcagatactttgtcccaggtatttcatgataaggattgggctatgactctgttacagaagggccaaatgactaaaatgtctctgaacaatattgattgcaaatattctacccagttgtcaggtcaatatgttccaattcggaatttataacattgtatctctactcccaaaccatccaatctcacctacctcacttccatattatggtgggtgatctcagattatatttaagctcatggttacttgtcaagtagatatggagtttagcctaacttttgaaatttatgctgagattacccttctcattatagaattaagtaggcagtttccaagtttagatttagcaggcagtttttttcaaatcacttaaaagttatatttttttagggcattgaacaggtttgaaatcctaccaagatgtcatgtacacatagaccaatagaacagaatagagaacacataaataaaactgcacagctacagccaactgttcgtcgacaaagtcaacaaaaaaataagcattgggaaatggattaaagatttaaatgtaagacttcaagctataagaatcctagaataaaatctgggaaataccattctggacattggcttgggaaagaatttttgactaagtccttaaaagcaattgcaaaaaaaaaaaaaaaaaaaaaatgacaagcaaggacttactaaaataaagagcttctgcatggcaaaataaatgatcaacagagtaaacagacaaacaccaaatgggagaaaacttttgcaagttatgcatctgacggtggtgtaatatccagaatctatgaggaacctaaacaattgaacaaacaaaaatcataaaacatcatttaaaaaatgggcaaaagacatgaacagacatttctcaaaagaagatatacacgcagccaataaacatgaaaaatgcgtcacatcactcatcatcagagaaatgcaaatcaaaaccgcaaggagataccatctcacacccgtcagactggctttgttaaaaagtcaaaagacacccaatgctggcaaggccgcagagacaaggggatgcttatacactgttgttgggaatgttaattagttcagccactgtagaaagcagtttggacatttctcaaagaacttaaaatagaactatcatttgacccatcaatcccattactgagtagatatccaaaagaaaacaaatggttctaccaaaaagacacatgcactcacatgtttgtcacagcactatgcacaatagcaaagtaatgggatcaacataggtgtccgtcaacgttggattggataaagtaaatgttgtacacatacaccataaaatactatacagccacgaaaagaagaaaatcatatcctttgcagcaacatagatgcagctagaggccattatcctaagcaaattaacataagaacagaaaaccaaatactatatgtactcagttatgagttggagctaaatgttaggtacttatagaattgaagatggcaacagtagaaactagggactaatagaaggggaaaggaaagggggagacaagggttgaaaagctgcctattgtgtactatgcttactacctggttaatgggatcatttgtatcccaaacctcagcatcacgccatatatccaggtaacaaacctgaacatgtaccctctggatcttaaaagttgaaaaaaaaagatgtcatataaatattcgtggtcactaaaagtatctaatgtattatacataaaaataaaaattgggtgaattggaagtgtattctttgtatcaagtcatgtcggagatcctattctgctttgatcacagtgtgaattcttttgcatttttgttaccagtcacttctttatttattgaactaataattacatattctgataatctgtcagaaagataaaaacattctttgtccatgtgtctgaaaatttttaacctatttttctaatgttttaagtgagaagagcatgttaatactgaaattgtaagcagtagactgaaaaatcatcccaatccatgggttatatattgaattgcttttaactgtattactaaatattaagcttaatttattttatttctacatatccccatttccactataggtgatttgtatgaatttaggaacttccttctctcatccatttttatattaaaactcagactttctaaaacaatatttctatccatccatcgttggtaactatgtactgacatgttttgtgcatccgaaaaatgttagcattagtttgtgcgcacagaagtaattccagtcaccatatgatgagctgatttatttatttcgtaagtgtgttcattattattatctcttcagcacccaaatatataggggacttaatgatacctacaagtaaaaacggaagacaaaaacgccctgctctctacagaggttaaaatgtttttgcaacagggctctagatctcagctgtgaaagtagggacgagatgaggctaggcatgcagtgtcagtataatacaatataatcaacatgtcagcatctaatgcaggtgttgcaaaacaaaatgtacacatgggtagtcaggtaacagaaaagcatgaagtagtaagggctatctatgcaagaggttccaagctgactatatactgaaatatttaaacactatgtggggcaaataaaatggacattagaacagttcgatggtcagttggggacttctgctctttcttccagtctctgaacatatcttaaagccacaatcatctatttttatttattgttatacatttatttataagccagcacccctgtgatttaagttctgttgaaatgctgagttggaaaagatcgatggatgggggaaatttagtgcagaggttttgccccaggttcaaaatcctttataaaatattaatacatggaacaaatattgaacaattaaaccactgataagttaatcaatctgattcaaagtacacctgtgaagagggacatggcaagaaaaatattacagtaagaactagaaacattccttcatggctgcttgatatggatatgtcatgtttaagaaaattcttctttagactgttgagattttttttcctgacaaagaagattcactgtcgaggaaagaaagaggtactgtgaaatttgttattgaaaacatgcacatacttttgtcagaatgagttaaagagtgaacaaaatgtgcctattacttacgtgttgtgctgttttaattcaagattaaaatatttaacgtccacagacaagaccacttttatatgaatattatttttctgctttattgctcaattttattaccatttcaaaacacccgtgttgctttctatggccaaagatgtttagcacttttcatggttatacttctgtacagtccaaaatacaacacttactttacacatacacaaacatccaatgtattttgttttctgtcaagtaaagacaatgtctgtgttattaagttaaatgtcactttcaaatacaggatatgttgatattagaatgttcaactttatttcctcatttaagcaaattacagtgtgaagaatgtaactgcagcaatttataaaaatcatatcacattcaattatgagagcaaacttgttttgtagacttgaactagtttcaattaatcttggagttatcatttcaaaaattctaaacagagagaaatacggagtgtaataatggtaggtctttgggtaagctgcttccaggaaaagaaagcaattatatatgttcacatagcactgacaaggagaaacaaaactttggacggcaaagaacttgcattagtctttttgacatgttcctgtggtgtgatttattacgtagacaatcagctcaacttctcaagtttgatatccttggaatcatttgaaatttaaattttaatgaaaattcattaattccaaggccaaaagaagtgattctaattgcttttgagaatcagactatgaaagaattctttggcaaacttgcactgtcttttctcttttatcattggttgcttcgtaggtacttaattgaaggtcctctgattatcagcacgggctgacatcagttcactccatgcattttaaacagtaggccagatgtttaaaggatcagctgaagcatcgatagcatgctagggtgaataataaaattttcattatctacaagaagcaaataaaaagcataagcattttcccccattatcctgaaggagaagatgaatgcctaagcaacattttaagaatgggttgagtgtggcctgtgggaaaatttgggtagaaaacttgtagttagctaatgtatatactgtttgcctctttagctcaccatatacccacacacatgggcatgcatgcatacagacagacacatacaatacacacaacaaacaggaaattcagatatactgaagaaatgtatttaagggattactaagtttttgtaaataaaatcctttaagatgctgagaaacaatggaagagaagtaggacatgatggctcatactttcgtaatttacttgtttaacgtttgccaaggtttaaattaatgtagatgtttttgtggctaggattaatgatctaacagtttggaataattaggcacttttatcacctagaaagcccagaaacccagcatgcaaaaattctggtatgtctgcattttacacttagatataacagagaaatgacaagtagtcaagtggatagagaaacgaatgattcttcacacatgcacacacacatagaaattgtctttttaatagtattttaatgtaacacatttatgcataatttctccatagtgtttatcttatagtgaatatgtgatgaatagtctctaacattagtggttttatagattaaacataattaaggctttatatattaaagagtcaattggtgacattctaatataaacatgtttatctcatatacattgaaatattagataattcattcgttgagaataaatcgaatgagtcaaaacttttaacctccactttgagctttgtaatagtatccactgaaaatattcatgaaaatttttaagtcatttctatttatatattcagtccaaacatctcacaagtttaaaatgtaaactcaagaatataatttctgtattctacaattggaagcatccatcatatcagatgaacttatatagtttgtgaaattttgcaaactttctgtttagtaaatcttaatgtcaaacattttaacttccaggttgtctttcttttcagttttaatatccgcgatctttgtatactcgttgaatggattctcaataagtaacccacaaatatatatacatactatgtacctacaaaaaataataaaaagtaaagaaatcgacacttatccatacctgtcccatagtaataaactattcataagtatatttgaaagatatgagaatcataaaagttcgtgtttgcacccttttgtgcgtggaatcctaggtttgcattttgtggatctagactttttggagtgtggaaataaatgaaacaaataatcgagacccagtcttatattcaggttatcattttactacataaagcataaataacatttgcagtttgtttctatggctagctctaaagtcttagcaacgagaacattatagaaagacttcaactgtagcttccagcagaacttctgaggttccgtttatggactaagcagcagttgagggggacaaaactcataggcaattgatcactccaaaggatagattgtcttttctaacctaatcaaaagatttatagtgaaggcatattcagattttgttgaaggatatggatatataatcatgtgtgtgtgtgtgtgtgtgtgtgtgttagacatacttaaaacattatttgagtagaaaattctgcacaaatggaaaagtataacatgtgttatatccacacatgttgagcatttacctggctgaaacatcaaaagctgaattgacttaattgaatgttgaatacttaatagttactttgtagtgactcactattaaaacattatctcaagctttgtcagaattaatttttttaaaaaactcagattagtgtcaggtttactgaaacagcagatctgaaattactgtgtttttttttcctttcaataatcagtttctaatccaaaattgaatatcagttccaactctacattcagtttctgttttacttgtttggactggcttttggttctgttttccacatagatcctctctgtgtaagacaaagccatttgtgcagattaaattttactgagcgtgttaacctatttaaaacattcatccaaaaagactagtatgaattcttcatatggcaagctgcttgttttaaaacttccatttattctaaaatcctttttacttatactttttaagaaacgtattcccgatatacaaaagtaacacatgctcattaaaacaaattaaaaatagtattgtataaagagctgatacatttctgccttgccccatttaactttcttaagtgttcatgtgaatcatccattcacatcaagacatttatctgtattcatatgaacgtgttttaatatatataacatatatagaattttatataaactttccttttaaaatagaaatgaaattatatgatatatttattctgtgtctagctcttgtcacgtaattattcaagaacatatttctaggttaatatctgtattcttaggtagcattcactaactcctcatctacttgttttcttccattctaattgtgtttaacatttcttcatacaattggttgtcatttggtcttctttcatggagggtgcataatgttcattctcaccaattctttacactttacataactgcttgatacgaagccagaccttataaatatcaacaaagcaggaacactgtaatcagctatcagtttcagttgagctgaatgaccctgaatatgtgtacacatattttccaggagattttaaaactgacacctcagatttctaagacctggagaaatcagcatgagaaacattgatctatattattccgtgaaatgatttcactaaatagtgaagcatctcccacatgtggactctgtaatttattagaataaagagttcatgtgcttctgaagaacttgaactactcttctggcctccgtacattggtttcttagctataggaaggctgagcatgtttttcctatgcgtttcctttctagctcatcattttagtgacaaaacaatctttcgtggtgttgctctagctatagaattgtttcagattcatttgaccaaaggtggcaaatacaacagtcccaacaaaaacaaaagacctattacagaatgatggaaatgaccccagggaacaatggcacctccacatttcttaattccaaggttataagcagtggtgtggacaattctcaattccaatgctgaatcgccttctaatttcaaatacctgtgctaaaaattatttacgtctactgaaataatgaactggaccccaccaggaatggccgatatgcttgtagtcagagcacaactgtagaaagaaaataacattttaatttatagaggtatgatgatagctgtttcatactgttttcagaacgatgaatggcctgctcagtagtttcttgtcatcgtactgagacactttaatttcttaccagctgagatgaggaatacgagcccagtgtgcaggtgaaattggttaacaggagccattaaaatttggaagagtcagaatagcatcaatcaaaatgctttcagtgtaggaagtaaacatgtactagcctgacccacctgtcttttcttttaggtatgttggtaatattacaatcattttgaggtatccataaacaactgcttagatctgaagaattgtatatctttctttactctgccctggcctggggttatggttctcattgagctctaacctttcagaaaaaaaatgtagagaagtggttcaagaagaatgctttatcttgcttcataaaaatgatagtgatagttttattgaaggcttactatgtgccaggccaaagtgcgttttattatcgttcccattttccaggcaaagaagctggagcacagagaggctaagtgagttgtccaggatggctcagctaacatgctgcagttgggatttgcacccagaccaacttcttttcaaccactgtcccatcctgtgtcttctctactcaaaaagtgtttcagctccaaacctgaaactttaaagaaaaggaaatccttagtggaaagactaggttttagtcacaaattatctccttccttacattatttgtctctttttcaaatactccaagctttgattaaaactgtctatcactaggaacattgtagaattgctaaggtggaattgttaaaagaactcaattccaattaactttgccattgattactgtgtgttctggaggggtgttctttctttcaggttaatgatgctttattgtatatctcaaagattaaaaataacaatgaaggaagtagcaaaccggaacttctctcacaatgcatctttcaatctcgtgctttaaatgaagataaaatcatggctgtggtaaggttgcaggaaggatgatatagattaagtttcttgcaaactgccctctgaattttcaatagctgtagaaggtattggttttccaaaaaattgacaaattgaggattcattcagcagtttttttctaggtctcttaccagaaagtgatcactaaaaagtgtagggaaaccactcaaagttggatagatcattattttcacttaagcattttaatttcttgaaggagctttataatgcaacaaagaatttacagtcctgtgtcaccgcttaaattttctagggtcatcagtaaactcagtggaaataaattagttcatgaatataattgacccttaaattctgtcactgtgcaagtaatcggtgggtctgctggatatggctttcgagcagacaggtcaacttcttcaaacagagaagaagcatagcataaattgaagacaaataacaaactacttgtttcctccttctttggcatcaccctatggatggagtatgcatttataatttaacacaatcaagagatctttattatcctacttttgggtacaactgcttcgtttctcttttgaatctctacagctatttaaaaatctgttttgtaaaattctttaaaaaactaaaacatcagattcatatttcaggtatcttactatcttataccaacttaagcatccagtattatcacccacccttcccctgagtgaatccttagcactgggctcttcctgttttatccctgtgcatgctgagctctttctggccttcaagtctacttccgttgcaactgttgtctgaatggtctctctatgtccttcttactctctaaatatttcggaatttaaagcctggaataatctaccttagtccaaaagatatgctacactattctagttcacaatgatctcacactgccgttgatacacaacatttaatatcaacttaatatctatttcagttcattacgaggtcacttatgctacatcttatattgttgccttggacttttattatctcttcatatatgtgtttatggtgctcccaccctcacgagaagttgcaaataccatgttagctgtctgatggctttctatgttgtcaggtataccatttcccaaccagttggcattcaatgattaagttcattaacaaagaattgtatgtgttgaaaaagatgtttttttcttaatgaagcacttgtttttatttttttaatgaaatccaccctcttaataaattttaagtgcacaatacagtattgttaaatataagcaaaatgttgcatagcagatctttataatttttttaaccctacatgcctgatagtctatacccattgcacagcatctcaccatttcttccctcctccagcccttagcaaccaccattgtactttctgtttctataattttgactactttagatacctcatgtaagtggatgcgtgcagtatttgtccttttacgacttgcttattttatttagcaaaatggctacaagattcatccacattgtagcatatggtaagatttcctttttgtggcagaatgatattccattgtatgtatataacatagctttatacattcccctgtcaatagacatttagtttgttcacacctcttggctactgtaaaaatgctacaataaacatgggaatgcagatatctcttcaagatcctaaattgaattcgtttagataaatatccagatgcgggattgctagatcttatggtagttatattttttatttttttgaggaaactccatattgttttccacaaaagctgcacaattttatatttccaccagcagtctacatctccaattttcctacaccttcaccaacacatgtaatgatcttgggctttttttttttttttttttaataatggttatcctaatccgtgaggtagtatatcattgtggatttgatttgcatttccctggtagttagtgatgttgaacatcttttcatataactgttggtcattttaatgtcttctttggagaaatatctattcaattcctttgttcactttaaaaattgggttgttcgaatttttgttgttgttgttattacgttcctcatgtattttagatattgacaccttatcagatatatggtttgcaaaccttttctctcattctataggttgcttttaattctgttgattgtttcccttgctttgtagaagctttttagtttgatatatttctgcttatctagttttgtttttgttggctgtccttttagcgtcatatccaaaaaaaattattgtgaagaccaatgtcaggaaatttttcccttatgttttcttctatgagtttcatagtttcagatcttatttttaagtctttactccatttcattttgagttgatttttatgtatagtttaagttaaaggtccaattccattctttgcaatgtgtatatccagttttcccagcaccattggttgaagaggatatcctttcccagttgtgtattcttggcacccctattgaaggtgatgctaggtttatttctgggatctctattctgttccattggtctatatgtctgcctttatgacactatcgtgcgctcttgactgaggtagctttggtaattcattttgaaactagcaagtgtgatgcctccagtttattcttcttcctcaagactgttttggctatttggagtcgtttgtggtttcatatgaattttaggaaatttaccttatttctgtaaaaaatgcgattgggattatgataggaattacactgtatctgtagatggtttggatatatagacttttaaatgacacatcagatgtatttccatttatttttgtcatcttcaatttctttcaacaatatttcatagctttcagcacacacatcttttaccttcttggttgggtatttactaagttatttattctttttattgctattgtaaatgagattgttttctaaatttcctgtttttatgttgctagcgtatagaaacgcaactgttgaatgatgactttgtatcctgcaactttgctgaatttgtttattggttctaaccatgtctctgtgtggcgtcactcttaagattttctacgtatcagatcatctaatttgcaaacagatataattttacatcttcctttccaaatttgatgtattttatttctctttcttatctaattgttctggctagtacttctggtacgattttgaaaagaagtggcaaaagtgtgcattcttgtcttgtttctgatcttaagggaaaagattttcagtcttttgccattaaatgtgatattcactgtgggtttttcatatacggtttttattatgttgcggtaatttcgttctattcctagtttgttgtgtgtttttatcatgaaagtgttgaaacttgttaagcgctttttctgcagctattgagatgaccatagatttttagcctttgttctgttaatgttgtgtatcacactgattagttttcataaattgaaccatttttgcattccaagaataaatcctatatggctctcgtgtataatcctttcaatatactgttgagttcagtttgctagtattttaatgagttattttgcttctatatttatcagcggtattgttctgtacttttctcctagtgtcttttattgactttgatatcaggatactgatgccccttgtagaatgagcttggaagtgttctcttctctttaatttttctgaagaatttgagaaggattggtgttaattcttctttaactgttcattagatttcaccagtgatgacatttggtcctgggcttttctttgttggaaggttttggactactgattcaatctccttactagtttcggcctactcagattttctatttcttcaagattcaatattggtagattgcatgtttcaaggaatttgttcatttttttctaggttaacatacagttgtttacagcagtgtcttataatcatttgcattctttttggataccagttgtaatgtctcctctttcatttctgattttacttatttgaattttcctttttttttttttttttttacttaatctacctaaagatttgtcaattttattgatttgtttttaaaaaaactcttagctttgttgatttttctattgttttctatttcaattttggcttttttctgatctaatcttaatatttccttccctctgctaactttgggcttagtttgtccttctttttctaagtctttgaggaagaaaatggcaaggacatgactttctttagcagttggaaggacaatgctgtaaatactcaaaaattaattatttttatagtgacaaaaacaaaataaaaaacacttcaaagcaaatgaaagtttatcatttaatttatcaaatcactaagcagactgcttgatcagagagaagatactcatatgatcacataaaactgaaagattaagaggtaaggacattcatgttatcattacatctaactttcttatttccaagatggagaaactgagggttggagaaaaagaaagatttctttgttagatacaaacagacaggactaaactcagtatagcagcctcctaaattccaaagtatcatgatactgtgattttatgcattcttcagaaaaatagtagagccactggattctggcaaagaagttatataaaatgtcaagttcttcctttgcctcagaaatgaagttttatgttccaaaattgattgggaagttctccttatacctcacatcacgtctactattttacattgtttacttttgaagaatttttttaattgacaaataataattgtacatattcatggagaacctagtgatgtttttatatatgtaatgtatagtgatcagatcagggtaattagcatatccattatctcaaacattggtcatttatttgtgttgggaacattcaacgttctccttctagccatttgaaacttctatattattgctaactatagtcaccattcagtcgtatagagcactagaacttatttctcctatctagctataatttatttttaaatatgctttttgaatctgttactataaattgaatgtcacatcgttttgaaaatattcttaatttatgctcaacaggcaagattacacacctgtgataatatctttaatttaaaacattactctgtttaatttaccagaatatggaaccctagtcattttagaggtggagcaaatttcagtgataatctagtgcaaatttctcatcttatgaatgaggagattgagtctgatataagggacgagattttcgtcaatgagcagcttgttaacattagctctgtgatagaacacaggcacttgtcctcccaggccggtgtttcttctactctatgatgggctgttttgttgtagtttttaaacagcagcattttcaccatgcatagttttcttccaaagttcgttcttaacgtttttgcacagaataactagattttggaagtagaaaaaggaaattctctttgcatccttgtatctctggttattttctttgtcctttgatctctctctcctcccctcccctcccctcccctccccttcccttccctcccctctccttcccttcccttcccttccctcccctctctcacacattagagaaagagttaaggtattaaagaatacataatactattaaatttccttcacatagagaaaggaatgaaaaaaagtgaaaaatggtcctcaccaaatgtccaaacttctgtaggtcatttccatagtatcagcaatgtcctgtatggtgcctcggggatatgtaagcaaatgagcaagtggttagctaattctagctttggcaaacacttgttatggcttacttgaggagaagtcacttctccaaagtgaaaataatgtgcacaggtcaattagaatttttttgtagaaaaggaaaatactttgtagggacatggatgaatctggaaaccatcgttctcagcaaactattgcaaggacaaaaaaccaaacaccgcatgttctcactcataggtgggaattgaacaatgagaacacatggacacaggaaggggaacatcacacaccggggcctgttgtggggtggggggagggtggagggatagcattaggagatatacttaatgctaaatgaccagttaatgggtgcaggacaccaacatggcacatgtatacatatgtaacaaacctgcacgttgtgcacatgtaccctaaaacttaaagtataataaaaaaaaaaaagaagaaaatacctccttatgctcctgacttattttctttttggttcctcagtcctcttctctctctctctctctctctctctctctctctctctctctctctctcacacacacacacacacataccccacatatacaatatgattaaggatatatgtgaataatgaaagcttcttgtgtatagatttagaagtctaatggacaaaatcaatattttcctatgtgcatttaattcccccctttgatttaggtatatagtctttttttaaaaaagagaaaaaaaattaggtgaccttaaggtatagatcctactttcaaaaggtttacagaactagggagaggaacatggacaagatttaaagaactattttaagcagaataaaatgtgatttatgaacaaagcatatattatttgtgcgtatgtgtgtgtgccaacaaagatgcaattaggagattgcacagggagatgtcattagaaccaaccttaacgggtgagaagtctttgaagacatttagaacatggaagatctctgacagagggaacaaaggcatagtgacaaaagtcaagggcatatttaggactggagagtggtatgtgtggcttgagagtgggcgagaaaaaacaacaatgcctctgtaataggaaagtagacagaggcatgacattaagagctttgccagctgtgctaaaagtagtgaacaagagctaacaaagtgaagaaatgtaccttttctgatgtgtatcattcccttattcatatacttcttgagggggaaattcattctgtgttgatctagtaaactactacaggaccaaatgataaaaagaagtataggaaagaatgtttcagcatactttacgagataacttccttgtagctattctccatagtattttgagcatcacaaagcaatgagctgaaactgtctaagccaaaattgacttgtcatctgttagggatgcttagatgagaattctacatttgagagcttcttagattcattgaccactatgtcccattctaagatccatgaatgcgtgacctaactattacaccttcttttagtctgattgtcaattttgtattttcaattgtgcaagtttctaaaactattttaggaagataaatctagcagtggtgtgggaatagacaagagagaaggggaaagactcttcaggaaactaaactcacaatttatgagtattctttattgcccaagtcttcccaaagtctttcatcaagaaagaggcattgcaactctccttttatagtttgtttttattctggagcagtgatgttttggtggagttgttcctcagtgcgtaattaaagggcctatgacaattacagttcatctcctgctgctcaaggtactgcagatatttggatctactactctcattcatttccaattaatgtcagctttagatttccttcagtatgctatgttataaaatttgattatcgttgtgcccaccttcccacttaatttcaagcaggtttctcgattacctgactaaactaatgaaatctgactaacccaatatctgtggacagtagtgtgatgttactgatttttgtatgattagtcaagtcatattcatgccacgttttcatatagtaccataaaggatattcttctcgtggtccttttcttttattctgaacatacaatgagaagaccggtaaagtgggctaggaaattaaagaaaaatacaaatggcaaaaaatatgggtcactcgaagtctagaatagagagcacaatcaattttgaattaaggggtgataaggtgatttggtcaggtgactggtgaaacaggaaagaaactatactttttgaagtgtttcatccatgtgttaagattcatttggggtcaagaatctaaatttcatatccctgggagtggaaactaagtaaaaaaaaaaattatggaccttggtttaatagctagaggagcaagagtgtatctttatgtgacttaacttctatgtgaaaagtgaaccttaagattaattattgggggaatttacttactcaggttctatgcctagatggtctgcccaactaagaaaacttattttcctgttactccatcctatttttcatacttttatactgcacttgcagaaaagcatatatttctacccaatacgaaaattcctgggaacatatttttctacatttcccaaattacttcaaaaagtaaacttaggttatttcatgatctccattacaatggacaggtggccttattgaatgttgtcctgtgaatacaaagatccagagtttaaagaacaaggtgtacttgcatctcccacttagggtttgcttgtggtggagagagaatctagtttgcttaaaaggatgacagtgcagtgccccaaaatatctgatatcattaaaagtctcatatttgtctttcgtaacttctctagggctgtcgatgacaggagacccttaactcctatgccttgattatgtgaataagcacatgaaaatattttagttatcttagttcacttttaaactaagtttcaattatcactagattctaaatatcatcattgagccgttcttaaggaactgattttctacatattcattcacttcacctatatctagtgtgtctactatttgccaagaaaaatttactctcttaattcagcattccatatacttaacatcataaaaagtaggccatttttagttttctaaattatttatttaaacatttctttaaaattacattctatcattacactatatttcaacactacagtaagcagcctattttgtgatttttccttatataaaatacataattgaaattaaaaatgaagttaccaagagccattttcactctggggaatgcacatttataaattatggggttattttttcttcatcagctttcatattattaaactttgtctcttcataattacagagatgactagacacagaagggaatttaacatttggtgtgcatttgtctaacctatactttatgttagaaaatacatttccatttgaaaaaaaatcagtaattgtgggtgtgatcaagagggcagcctgaaagtcgggtgatgtgactcacacctgtaatcccagcatttttggaggccaaggtgggattatcgattgagcccaggagttcaaaaccagcctgggcaacacagtgagagcctgtctctattagggggaaaaaaaaaaaaagaggaagttagcctgaggcaatgtaaatgaaatacatatttcaaggatatttatacatgattcacgttattcatataaagatgtgccagagaagactataggtacgttattttacactattttgctaggattttaagaaattcaatgtgtttttatttcagttaacttagaaaacttacctaacttatacttctcatggacacaaaagtttttaaagataggatcaaaaagcccacatggtgaagcattttgaactggatgaaaaacatctattatctttaaaattttatgatattactgattgtaatagactccctttttaagaaatcattccttatagaacataaggtttacatttacaatcaacaatttctatccttactacaataaaggcacatataaaaagtacagttgcatatttagcaggtttaattgtacattttaatgtagaaatcaattcaattctttcatttatcagcattattacagtgatttcaaattaagcataggtaactttgatatagataaatgatgtacacagcagttaaattttattttcaattatgtagtaattgtataacctaggcagtataatttgtaaactttgtattttattattatgcttctcccacttggcataagcacaacacttcctaaaagcataattttctatagacttaataactccctaaaaacctgttttggacccctatactatttgatataggcagaaaaaaaacataatccatgctcaaatttgaaaaatgactggtcacatttggtataatactaaaggtaaataaaatcaagagtctatgaacatttccggacctgcacatttgttttattaaaatgcataattgtctttagtgtgtttctatttgtttatactctactgattttaattaaaaataccaaaatacgtttattaaaaaactgtcagaatctaagttgttaaatatacttaactaggaaagtaactgtttaaacgagataatttatagagaaatgtggtgtattgccaattagatgtcaagatacaatacaactgataatgaaaaagtagcattttcttagggatggaatacagtgtaaggaacaccccagtaagaatacaaaaattactgaaaaaaaatcttccttcctgaaaaaccaagtgcccttcaagtgcagaacctcatccaactaattgttaggtatcactaaagcctgataccttcaattttctggatcattcaagctgtatttttgagtccttatactagaggaggtaaagagctataaaaacacttaatggtatctgatgtgaactgtggatcactttgacccatcacttctacgtctacatcttggataaattcccattgttgtcatagattgtacaggtttaatggtgcgtttgtggagggggctcgcttatagaaaatggagactctgaagggataaggaataaatgtatcacttcaggtcttttatttgaaattggggtccagagagcctttttgtatcagacttgtcaaaccatttccatttagtaattatatatgcactagcacttattcctacttacctcacctctttatgcccatttccttgtagttgcggttatgcatgaataatttattgcaccccttaccaacaatggaataaaacttccattctgaaagctttccatactcatttccaatagcaatagggtttttttaacggacgtattacaaatgtacgagtcagttgaacatagtattcctctttgtaagaactccaagtggatgcatgctgttgtctcaaatctcaattagaccttgctttgaggtcccttcattgccagtcatctgttctccttcccctgacttgagtatttctccagatatagataatacattttcccaactctgtgttccaagaactgacagtggctttcattcattttgtttgtttgtttgtttcttctcgttctcaagtatcccgcagtctactgtttcttccctccattcgtttgtcctttcagagtttcaaaatccagcataggtacttcttctaaaatgtcttacccttcacatacacacaccacttgagaccccatcagcctctgtccacacagtttggttacattcatagactatttttatacatcaaaatatttgaaaattttagggtaaatctcagtagtcattcatttttgctcttattcaaccaatactagtcaatcagcctgtgccaggttttgttgcaggtaccaggtatccatccataaagaaaacaacgtccctttgttgtggaatttacattttagcaggggaggcaaagaacccaataaatatgataaaatatcagattaaaagtacgatgaaaaaaatcatcagggtaaaggaaaaagggaagcagtattttagcaagagtggtgaagagaggaggctgagagtgtgacatctgagcagagacctaaatcaagtcaaggaatgaaacatgctactatctaaagaaatgagtcaggataaggaactagtaagagccgaggcccagagatgtgaatatgctgttccaggaacagcaaagagactggttgatatgatgtgaaaaatgagaagaaaccttatgatatgtgtcaagagaaaaaaaaaatttaaaagcatgcttgggaacggaggcctccagatgaaaaaaaaaaacacagttcaaatccttgttcatgcatttagtttgctttgcaatcttgggcaaaatgttaaatttctgtacgttttatcttcctcatttttaaaataggcacaaggacatctacttaataggttcattgtgaggagtaaatgagatgatatatctaggatgcctggcattatatcatacacttaataatacactgaataaataatagttatgtctatttatttccttatcgtttttattattatttcaatgcacagacctgttcataagataatgataaatattagtggcagaaactgaagatgttataaattattaggaggcgggaccactcagttcaatgtatctgttttaatatagtcagcaaaagtgtgaagataccaacaattaaatttcaatgcattcttccatttcactagttttataaactgatgaactaccagaatgtcaatgtatgaattgcatactcattcttaacaaacagatttgcaaaattatgtgtaaaattagccctcagccttccaatttgttattgtcatatttcatggaaatacataatctgtaaatttttgttttaatgatatgtgaaactgcctaaagtagagtcttggcaactacttcacatttgtcctccagagatagtggataaaagtgtcaataaatgaacactctatattcactaatcacaggcaagggacaaggaacagagtggtcacaaaataccacaaaattaaagcacattccaaattaaatatatatgtttttattacagataatgtttgctagactctttctaattatctgcaaagattttaggaatgttttaatgttttaatatttacacacctgtgtatttcaagttcagtcaaacactattgttaaaactaaatcttctcatctctaataataagatgtgaacttatcttggaaggtggttattaggatgggagagataatgtatttcattcaaagtaaaaatatttctctgtttctatctttctctttctctgtcatctatttatcatctatatccaggtatctatgcacctatgtagactagcattcaatgaaccatagatattattagtagtagaattgttactaatattaaaataagaagtatttaagaagaaacatgtcctaaagcataaggtcaattattactctcatgttttttggcatatgaagcctaaaaagtgtcaatttcaagagagtattaataaagattgtgataactgaaaggttcctgcttgaaattttgtgtggtcttacaaatatataaactctaagcatttcagtgagccaattactgactaggcactatgtcttatgactcttttgtcatagtatgtaaaaaacaaagagtagagacatcataaaaattatagtagatgggcactagggaattacgcaaaataatttgtagatttaatgtgaaaccaaaacatctgttcaagtcaatttcccacaggtcatgtggcaaagagtatgagttccagactgaggagaggaaaaggttgttcttccacagggaaataaactgagtgtaataaacataatttttcttcttaagcattatttaaaacaaaaaaaatgccattaaatctatctttcctgcctctcttatcaatgctcccttccctttcaccacttgtttcaaactccaagccttgggattttattttggctttttgccttaatgtaactaaaatgagagcatcacaaatatgaagctcatcaaataatttagcagcattttcccctgtttttaactttctctttggaaacgtagatttcgaaatttaagggcccaaaatatgaaatgcaattataataggccatttgttcattcagcttgataaacttgaataaatagtattgaacttttaatgcaaaaagaacaaaacaaaatagaactctccacgaagaaacttttcaatgtttgcatttctgtgtgaggagaagggtaatgaatgtgggaaccttaatggaatccatgttcttccagtgatgacaagggtcaaaatggagaaaaatggtcactttctacccagtacattatattagttctatgtggacaactataacatagctgatgctggttttcaggccataaatgtaggtatgtattttcctactatttataaggcaaaatttctatttgtttaatgatttctatataggtagattattctgtctttaggattaaaaacgacctgtagaccaagagactttctaatgtccaccttagagtatatggcttttactgttacagtttccatttcctttgcttgcccctttgagagaaggaaaggagacatttgggatacatacatcaatgaggagctattaatgaataaatgaatgaaattgtcagtcaatttatccacatgatcatcaattgccaataattttatcacctctgtgggattaagtagaggtaacagtttagaaatttgattttttgaaagcatttaaaatgttcaaatatatcactctggtaactaagggaaagtgtattattttcttatgcttagtcttattttggttttgcctttttaatttaaattgaacacttatatcaaagagcttgcaggattataatttgaatttttgaagcaaagatcattttcttaacatcaaacaaagagtagatacaataggaataaaatcggcagaaaaacaagagtatcaaggacagacggggagggtgggtctgtgttagcatgtattgctatgaagaaatagccgagactgggtaatgtatttttaaaaagagctttaatcgattcatgattctgcaggttgtacaggaagcaggacaccagcatctactcagcttctggggaggcctccgggagcttttactcatagtggaagatgaaacaggagtaagcatgtcacatggccagagcagaagccagggggaggttgccacacatttaaaaaaaaaaaaaacaaaacagatcgctcaagaactcagctgctatcatgaggacagcatcaagctgtgagggatccacctccgtgactcaaacatctcacaccaggccccaagtccaacacttggcattatatttcaacaagaaaaaaagtttaattggctgatggttctgcaggctgtacaggaagtgtggcacaggcatttgcttggctcctggggaggcctcagggagtttttgctcatggcagaaggtgatgcccacacactttaaaaaaaaaccagatctcatgaaaactcactcactacactgaggacaatacaaaaccatgagggatctgtccccatgacccaaaaacctcccgccaggccccaccaccaacattgggaattatatttccacttgagatttgagtggcggcaaatatccaaactatatcagggctcatgtccagttatatgtcaacatgcctgcattcgaaacatcctgtccaaatcactgccttgtcataatacttatatttttctttattgaatacgaacacaagaagattaaataatagcatttctactttaaaacagtgggcaccatattaacattggaataatagtagtaataacgatagtaataacaatgatataggctgggtgcggaggctcacgcctgtaatcccagcactttgggaggccaaggcgggcggatcatgatgtcaggagatcgagaccatcctggctaacacagtgaaaccccgtctctactaaaaatacaaaaaaattagctgggcatggtggcaggcacctgtagtctcagctacttgggaggctgaggcaggagaatggcgtgaacctgggatgcagagcttgcagtgagccgagatcgtgccactgcactccaacctgggcgacagagcgagacttcatctcaaaaaaaaaattaaataaataaataaataaataataacgataaaaggatatgtgtaggttttttttttaataggctgttaacattaataggcattgtgatttcagggatatcatcaaacatcctggtcctaagacatcccctattgaataggaagggcttaagttaaacttctcatgagccacaattttctgattatatgtttggtgtgtgtaatagccacctcagtgatgatttgattagcctggacccttacataatcattgaagtatacccatgttcctttatatacttctttagtgttgaaagctcaaaattaagcaaaatagtccccttgataatgtttagattcttaacatttgctttctaaagctggcaaatactctcttcccagtgtcatgaagttaaataacatgttgcttagtgaggactttaatgttgccatgccataggaagaccttattcgaaatccccttacctgggagaatgtcagattattaccccccaacttgtttaacacttttaggattttaaaggtgttcacatttgtattagaacaaaatactattgagaaacatttctagaaaaaaattatctttccaaattaaaatcagtggtatgtaatgtaggagtctgattataatgattaaaatacatgggctttgggcatactgcctaggtgaaactcctggtttattgcatcactattagtataacctatgggagttaacctacgtaagcctcagttaatttttctctcaaattgatctaataatcgtctctcataggcttgttttgatagatatttcagtgtatataatatacttaggacagtgcctgatatcagtaagtctccttatatgctatttttctttctattttaattatttatgcaagagaaactattatgctttaactcaattaaaataaaatgcctttgtatttattcatgtcaaaggaaatatgcaagtattgcattcacttcctaggtgcctttttgaattgagctttgcatggttagtttgtataaaaggttcagtgaactttctcataatgattttttattgaacatatggaatccattaagtgttagcaaaagtcactatccactgagctgtgtccaggggctgacagttatgtctatctcttgcaaaaataaacacatacataaatgcactaagacgtatattacctgtcgtcatctcttagagcatttccatttttcttttaagttttttctttcaatgggttttttatctttgtgagtacatggtaggtgtatatgtcaacggggtacatgaggaaggtgtatatattgatggggtacaagagaggttttaacacaagcattcaatatgaaatagtcacatcatggagaatgggttatctatcccttcaagcatttgtgctttgtattacaaacattctaattatactctgttagttattttaaaatgtaccattaagttattactgactatagcaaccctattgtgctatgaaacagtagatcttattcttatttttctaacatcttagaacatttccacaaacactacctgcttgttaaatatacctattctaatcttcatataatcaattacttttttcctctagaatgtactatgacacatccatggggaaaatgtagtaatctaattaagactatttcctctcattttatatttaaaagaatgtgctctatcaatttatttacttgtacagccgtaggcaacctctaaaatatttaaagttcttaaaagtcagatatttcagttaatattgtgattatatagttgattttgatgaacatgttcatctaccagaaataaattatacacacacattgatatggttaggctttctgtccccactcaaatctcattttgaattataatccccgtgtgtcaagggagagaccaggtggaggcaattggatcttgagggtggttttgcccatgctgttctcctgatagtgaatcatgagatcagatggttttataaagggctcttcccccttccctcctcactcattctccttcttgccaccttgtaaaggaggtgccttgctttctactatgccctttctactatgcccttcaccttctactatgattgtaagtttcctgaggtctccccagccatgctgaactatgagtcaattaaatccctttcctttataaattacccagtctcaggcagttctttattgcacatatatgtgtgtgtatgtgtatgtgtgtgtgtgtgtatatgtatgtatatatgtatacatatgtgtgtatatgtatgtatatatgtatgtatatatgtatacatatgtgtgtatatgtatgtatatatgtatacatatgtgtgtgtgtatatatgtgtacatatatatatatatatatatatatatatatatatatatatgaacagagagagagagagagagggaggaagggagagagggagggaagcatggagaaagagagagtaatagcctaaatagaaataaaactagctccaagtacaggttcgtcaacactctcctatcatacccccaccaaagttaatgttaaccacttggagccctgttcttccttagttgtggagtactttagcaaaattttaaatctaattatgcctaattcaacgacagtgctaatttgaaagtgttagaaactgaagacctataataataatgagagttacaaaacataaatagtgagacaatgatgaatgtagtggatgcatgtacgagggctatcatttgacagtagagatgatgctcaaggacagacaatgagtctttcaatgtgtggagaatgtgctgctgttacagtgatgtacaggaaagaaacaaaaactgaggaagtatcagtaaacaaaacactcaaacatatgagtatacagctagaataaaagcaacagtactagatgacaataagcccaatgttaactcagaaagcagaaggtttttaagaatttggggaatactgtggctgatgatacttatgtctcaagccacagatgccatatgggctctgcgcccagttgaatcggcaccacctggcagtaagtgggcaggtccacgactgccaggacatcccttccaacacttgtggagatcaccaggaaggggggagagacctgccttgacagattttcaatgtgggcgaaacaggtctattttgagaaaagatgttcaatagaacatatgtcagcaaggaagaagagatgatgcttagttctaaagctccaaagagctggcttacactccaacttggggaaaatgcatccgggaaatgcaagattaatctcatcttagccattcttttgaatggatggacatgacccctttctacttgaagacagaaaacataaccatattgatttcaggttttcttcattggtttccatttaggattgttcctccccatcttctttctgtgtaggcatcccagttcccaagtgttcatgaagcacgtatggccttcaggggatgtgtctgtatacattgttatcttatggatgcacggttttgtctgcaccttggttctgaatgtctttactcttgagcatctgcccatgggtccccttctcaaggcctcaatttcttgagtttaacactgcatggcccatgcagcttttcagttaagcatctcttgctatgaccaactcttttcctcagtcaactcccacactcttttcagggacaggaaaaatgtagccacttgctggctgcactctgaggcctcaagaaatttagtgaatctgcctttgcccttcttgctgatgaaatactgccacatcaggccccctcttcggaaacctacaagcatctaattttcttgcttcctccccaactttctttttgactcccccccatccagagagttcttatgtctactgtactaggaaaaactcattcttaaggtatggttttcaaatcattctctggtctggactttagctacggttttaaatgaagaaacaacccagagccaaaatataatgaaactatttccttcttccacagagtggaaactgctttggggttaaagggccagtgaaccaaatagaaaaggatctcagggaacacagattgaagagagagaagaaaaaatatgaaggcattgttggttctcttttgagtttaaaatctagtggggattgtaagcacacacacatatacacacacacgcttacacacacacaccagtgaagttatgaaggattttgtcactccaacgaccttgaatttgattatctaggtcagttgttaccaaagtggaatgtacatgcccaataatatgcgtgctaaacagttggggtagtgagaaaaaatactttttatttatcttgttctctagaaattaatattttgattgtatattttatagtgtatgtgatgtgtaagttgtgtctacaaaactagtgtcaatgtaatttaaaattacatatgtctgtgaatatatatttatatagggtacatgcttaaaatgtgtttacttctgaggtacatgaacatttttcccccaggcacagaaagacaaataccacatgatgtcacttaaatgtgcaatgtaagaaaagttgaattcatagagatgtagagtagaatcatggttaacagaggcttgggaggtggagtgagggaatagagagttactgttcaaagattacaaagtttcaactagacagagggaatacattttgagatctatttcaggaacattttgagaccctcactctaagtaataggaaatcattactttagttaacatatttgaatatgagttgtgatgttctatatcgtttatttggattctactaacccacacctagatttttatggcattacctttttactcactgtgaatatcctactcatagacagatgccctgggaacttggacttgaggcacccaagaactgagacagtgagatttgggggcacaaggatctatggataagttcatcttagtgatgataaaatcaatttggcatgtttcacggacagtgtgcattttagaaagggtaaagacttggaaacgggatatttttgagcccaagtgtttccaataaatagctgtataatttgaagcaaataattgattttttgttctctttgtgccctcgcctgtaaaatgggagaaatgtattcctttctcatccttctcatgaggccattgagagtatctaatgagatcagactgtgacatagcataataattctcatttcttgaaggcctattatacactttgcaagcactgtatgtgttgtttctacttctcttgttcgtttttcctggaataaatatccccccctcctttacattggattgccattattcaccctgtaaggaaggcttcatggttctcattttcatctgagaaaacttaggctcagagaagatcagtaacttatctaaaacacacacatacacacacagacatatctatgcccattattcttaacctagtttctctattcaggagttatctctgctgtctctgcttctgattataatctgtgtaagctgatccaagtgacacgattacagggaaattgtaagccctttgagagcagagactacctattgatatctacattttaaaatttgattttagccaacctgtttatatgcaatgactaacaggttagtttgacttgcaataaatattccaaatcctagactaagtaaatttattaatgtaatgatttaacttgattttttcattggcatgtttccctgaagtcgtcatgcaaaattgaaaaaaaaaaaagtatagtgtgtgattctagattgaaattcaggaatcctccagggttaccttgtttgctttccaaatagttcagattgcttagtctgaccaacaaggtccctgacacttggaactctgtctatccctctaattgactttgtccctgatgacctcgcccagagatactcttcaccccagctatactgtgttgctagagtttctctgatatcccatgctattgtttcctttgttctcttcataaggtaccatttcccacccgccaactcctgttttcctgatggacttttgtttcaccttacaagatcattgctaatgtatttattttgagaataaaaagtgtaggaaaggtcacgggacaaagctgtacaccagacctttcccagacgaacctagtgtataatctccctagtccaacatcatggcttaaggcagtcgatagatccgtcttaatgtcccttttgagttttctactattattatatgaggatttatttttgtctgaattcctccctagatttgccctagagagcaatgactatttacagtttattcctctttgtatctcttatgttaaggccagaccttggcacatattctagctgattagaagacgtttgttgaatgaccaagtgattgaacaaatgaccatgtgctctgccacagtccggtcagttctactttggtttggttatgtgtttgccacattaaagttgtagcctgggaagttcagttgtgagatgtctgcagaacatgaaaaattggaataatgaggttatttctaaaattgctataatttaaaataaatagtggtttattccatatatgaatatacactggaaacaaagaatttctagaatactggagattcaatgataacatcattgaaattaaataaataataggattatgctagttactttctaatttactagaaattgaccgtgtgcatggcacgtataatgagtatcatgggatagttacaaaaagtggtgcttagtgagtttctgtggaaaatctcggtaccaataaaacggaggatttccagaaatcgatattcctcaaagcttgacagtatttatgcacggttacactttgtgtgtctttcgtttgaatcaatggaaggaggctataactgaaaattattgttttagtgtattatatctttaataataagagttttaagaatctatcattagaaataattattcctcaatttgtaattctcaacatttgaacaaataaatgctctgtgtctatcagttaatcttgcccatgaagatttaataaagcacgctagtttttacaaatgtgattttagagatggtcattacttggtaaaatattttgtgttaacacttccatgaatatgttctgtgggaatatactgcctccacattgcttgctcatgaagacatgatttttcacatcatcctatcagtattttgagaaagagattgatcccatattctatgagcatttgaacattctctagtatttttgtttaatcattaaaacaacccttgaagtctatgtgctacactggttatttccctcttgactttcctttacagataaccctctatcataaacaacctatctatatttgttgtctccacatcatgttgccagccctgctttaacacactgcacattgacttctagcagcaaaggctcatgggaggtactctcatcaaggacactgatggtcctcatgttgctaaatttggtgggtcctctacagtctttatcctagttcaccttattatggaccactgtcaactctgttctgcttaaaacactctgttccttgcttatatgactctacactcttaactcctttgtgaattcctcatctgcccttccattaagtattgacgacatccttcatagttttgatctaggacctcttttcctcttacttgacattatgtgggtaatcttgtctttgaacgcaattaccattcttatgttgatgacccttaagctataattccagcccaaatcatttttctgaggaagctacaagaatacacaaatgtctaatagatctctatttagatgtccctcaggtgcttcaagcttaaaatactcacctgagctcatcacctcatctataaattctgcttctcctccctggctccctgatttatttaatatgaccaccatccacttagttgaataaagcagaagcctggacaccatctatacctccaattaatcactaagttttgttgttaaatacgttcttacattttctctctagaatgtcttattttccccatctttacacccaaaaccaaaagtcagatgaccctgatctcctgcttagatttcaaaacactatctcttgcctagactctggaatttcagtcttgctcctctccaatctatttctacaccctagactctggaatttcagtcttgctcctctccaatctatttctacacaaaagctagagtaattttttaaaaaacaaaaatctgaatgtgttcattttctgcctaaaagccttcagtaattcttatttgttcttccagggatagagtaacaactttcagacctagtttattagctagttctttaaccacaaaggactctctcacttgtctactccccctaacacacttcgccctaacctttgccattcctccctttcccttttccttcccagatggacttaagtcctttcagattcttaaatgtttcttcctccagtctcttacatctcttttccttgtaactctaaaaactacttagcttacgcaaggaaaaaggtctgtacaattcccggaatcagcgatcctaacgttccctgttgtttttttcgttgggacatgaattcattcacagtggctctaaacatcaccacccctgcctatctctcccattcctactttatctgagcttatccatactcttgaagacttacatattttttttctaccaggaaatcattactagccttattatcccactgtccaaaccaataagtctgattaggtatctgtatatatttaatattactatatgtgtttttctaacactctagtagaggagaaggtgtatttctttctgttttttagaagcctgtatttctgctattatagctcttaaggaactctcatgcaattgcctactagaatgtaagttacggtaggataagaactggatcagtcatatcacacatccacatataggacctagcaccatatctaacacacagcaggtactcaatacatttctttcccaaataactaaagagtttaaacaaaccaaaatgattaaatgagaagtaactgttttggtaattcttgtgtccttactagagtctaaattgagtgatttttatatcatcagtttatactcccctttcccaaccccaattctttcttttttaaattttttaaatcaaatatgccttaaaacttcaggatcagttgagtaaaatgatgcttttgtcgtcttttgcaaaataattgtatttcagaattttgatttagatattataaacacacctaaaataatagctttagtcttaagatgaagtgcttcttaaactccctaagatgggttggactatggatatgaacatggacaatatcacattaatttgtgtacacagttctaacacagggtctggcatataagaacaagtcagtaaatagttgttgaatggaattgaaaatttaagtagcaaataaagtattttgacctacaaagcaagaaatcacatttttctttttgtcacagttccttaggaagataattaattttttagtatttaaggatgttaaatatttattttatgttctatttactaggcttctttttatgaaaattaattggtgaaaatagcgtacatatcttcctttaccagaacatttacattttgggcagtaacgctggcttttgttaaaaaagcaaaatatgtgtgaaatttatgtttgagttgatttcaatgcattacatttccattttaaatcttctttgaaatactctatttttgacaccatgaaactgtattagatcttagtatgttagcaatgttttgcagttttagagccataattattttaatgaccactttcagcatatacgttttctacaggaaaaataatctcaagaacatgaaaagtgaaatctatattttgggtttcaaaatgatacattttagctaaaatatcatagttttaatttctcagtgaaaaatatagtgtggtaatttatgaagagactcagtgtttaaaaattatgactctatagtcaagtttatgtttataggacataggttattcaattacatttaaaataattaatttagaaaatgtgatcaatgtaacaaattttacctgttcttttctaaagctaaatttgttgtttgaagtgtttcttctaaaatgctaatgaactatcaatttaattgttgagcttagagttagaaacttaattatattgccagaaataaagaaacaaatggatcccaaaagattcacacattagaaatgtatgccagggaaatgcttttgaatgtgttcaagtcatggcttctaactcgtaacttataacttgtgttatgtctggcttcattcccttaagaaaaaggaataataatgccttcggagagcatcccagctgtaagagctatgcattggtgtctaaaaaagcttctcactcctcataccatcctggtctgggaatttaaaaaattgtcatcttttgataatctgtatcacatagtcttctgcatagtcatatgaggttagaactgccccataacttttgcagggcctatagtaagtgtgcaaatggttgcctgcatgccacatatttaatatttataaggtataaagtcaacagactattaaatatatcctatctgctttccttgacaattatacaatcataatgatatggacatctagattcgatttagaattctctctctctcattttctttttcttctttctttctttctctttctttctttccttcctttctttctttctttcttctttctttctttctttctttctttctttctttctttctttctttctttctgtctgtctgtctgtcttgtttttttaaatagtgcaagcagtttattccctggcaaggaatttggaaaaaactcaaatagcaaaccacttgatacaataaaataaattccttagagttttgtactggaatgaggcagcttggttagagctaaccctaagcctgttatttaggatacattggcttttcttaagcttaaaaaaaattttactgtgttaatgacatttaacatgagatctatcatcttaataaatactacatgcacaatacattattattgactctaggtagaatgttggacagcagatctctagagctaattcatcctacttaactgaaatgtaatgtctgttgattagtaacttcctatttcgccctatccccagcccctggcaaccaccagtccagtctttgattttatgagtttgactgttttagataccttatttcaagtaagtggaatcatgcagtatttgtctgtgtctgtcttgtttcacttagcgtaatcttaaggtccatccatattgtttcatattgcagaatttccttttataaaggctgaatagtattccattgtgtatatataccacatttatctattcatctgccaatgggcatttaggttgtttctgcatcttagctattgtgaatctgttgccttttttccctacctcctttactccatcctgcactgtgaggaactctgtgcacatagatctggtcgccccatttcccacccacatgttcaagtttttcccactcacctcatgcaaagatttaccccttagccatacccagtaactgactttgaaacatttgcccagggagttgagggattctgaatgccagatcatgggagcggggcttctagtgagcatgttggcttggtcctacagactcctaatcagagctttgcctttgaaagcatggggcccaagggcaaggaccctacttgttaaggtctaaattttttttctgaaataaccacatcgagcttttatgtgtagatggcctaaattgggctaacccagaggcagtgacactcaagtagtttacatctaagcgctttccatgtgcttcttttcccatttctgttacttcttacaaaataaaaaatcagcatctcaattaccctgatttgatcattgagcaatctaaaaagtatcaaaatatcacatgtagcccccatatacatacaactgttatatatcactataaataaatatatacacattatatttaaaaatcaatactttaattttacatgtttaacaaatcactagcatatacattccagattgaacttacgagggatgtggaaaagattcagtgactaaataacaataaagtactctaaaaatgaaaatgtgaaatggagacagtataaatctaaaatcatatcacttatgaagtattgtttcaaataaacaataaaatatatcttcaatcaatttaattttattttagttgtataaaatctttcggtcagcattaacctaattggaacactaaataggtacatctaaaaaatataatcccccccaaaaatatgtagctcataagagataatgcattgaacacagataatattggcgttaaaaacagaactctaccacatttgcaacgaaatgtttatctgttcttcctactagaaaataataaaatagttctgcatgagcttgaactcgaagtattaggtgtacaaagaccttttagtgaatgaatgctagctgaaaagcaaattttaaatatgaaaaattagcaagacaaacatttgaatttgtgggagatgagtaaaactcctataaaaatgaattgtttagtgttaaacagattgtgtatgaaatattaatggcatattgtcctgagctccccttccgctgtttccatgtagatgactgaatttcaaacagaaatatgccaggaatgattacgtgaatgaatattactacatgagattgcttaaagagtatttcttcttttgccttctttttactttcgttatttcatttagtagttagaaaatactgtctacaaatatgtgagaactgcttaatttatttttgagacattaattaattcaactaaactatattgactgtgtgagagagattcccttggtgaatatgtggatttttgcggtggtaagaactctcctctggagcgcaaatggtattgctctaggaataaagcatatacctcaggcccagatgaaccagtgcaatctacagtaacaggttcaaagatgacctcatgacctactgtggactaataaaaatcaaggagacctactgcaaaggtttctgggaaattctttttctcttgcgttgaactaagtaatatacatatgtgatagttagagctgcagcctttgtaataccatgacagaagataacctgaaataaggctgacagacacaagagggagacctaagagtactgagagatatggagcaggaccccctgattgaacttcacttgcagcccccttctgcagttttcaatgacgtgaaccagtagaatccctttgtttactgtttttgattaatttgagtgcagctttatgttatgagcaactaatagcatcctcactgtcacaactgccctctatacggcaggcactttgtgatactaaagaaagcagtatacagagtagagcccagtgaataacagggcagatgttgcaattaaactgcctgtttaaattctagctcttccactagctaacttgtgactatctaagtaatttaaccttcctataatcatacctatcttgaagacttgttgtaagatttaaagcacaacagtgctactataaaacaggtatacagtaaagcttagctacttttttattaggccatatgatatcatttcattaaaatcttatagccatgctataaggtattatgatcctcaatttataaataagacagctcaagttttggtcaagtgactttaccaaggtcatagagctagaaaataatgattccaagttacaagccaaacctcttcaatgccaaatttacatcatcccccattacttgaagtgtaagattcacatggacagaaatttttgactgtttgatcactgctatctccttatcatctaaaacagtctctggtccatattaggtgttcaataaatatttgtagagtacataatttccttcacagactccacaatctggtgaaggaggcagacatgtaagagaattatttcaggattccacagttgatgctgtaacagagctaaatataatgaatggaggaggaatgaataagtttgtctgggagcaatgctatggctattgaaataagtcttgctcatgctttgattgaaatggtggatatagatcacacaacaaataacaattagataacagcttgttgggagaaagcgaggatcagtgtttgccataaacatttctcatagctaatgtcaggtgtttgatttctcaacattttatatctttgactttgattttctctgtttttattttttaactccattctcaagaagtctgcacataagagtttcaacatctagcacttcataactccgtcatctcctctcaggcttagagcaaattctgagacgtggatttatcgtcgagtgatttcttcctggcattttatctctgagaccaggatctggttgctaagcatgtagacatagaaatgcatttcttcattgaaccccataggttcaaactagtggataatgagcacaatgtcaatgtgattatttgtaatgggggaaaggttaccggagaatattacacgaccatccacatagactaacattttcctcatgactaagtttacttagcaaaacaaattaaaaacagaagtttgtttagcagcacagaattgaaggaagacaaccagatggttatgaggaagattcatccaaactatgccagaactgaaagaaattaagttcattcagtacaagaattgtctagaataagagaatccattttgtgtcagcacttcccaagttcttgttaatgctaccttaagttcaattcaaaccaggcagcatttattacgtgttgtgctgggtcctaggaggaccgcgttttaagaacttactgtgatcttctagatcaagtttttatttcaatatttctacctcatttctgattcttaggtgttccttatttcccaatttatcccctgcagaaattgaggcaataagatgtctatcttattgcctatggtgttgattatttatgttatattctgttttgtgaagtttgacctctacctaattaaattacattttcaattgtatcttggattgatttattcaataagtattctttaatatttttgcatgaggtcggtcaggtttcatcagacattaggaattaattataaaaatctctagattggtacttggagcttaaaggaataaggtggtggaacgttaaatgaggaggaaagaaccagcagagctgggataaaattcatctctatcatcttcccacctgcttgatctctggcatataatttactatccgtgaacctcaggtttctcttcagaaaagctgcagggttgttgggggaaataaggcaattcctgggcttcagtatgttcaaaacagagcattaatattattatagacttttgatgatttacacaattttagctttttggcaagacatatttactagtactaagtaaaagcacgttgactttctaaaatgaaaatgtgtatgtgaggatgaagaaaaagaaagtgttttgtttgataatatagcattataacactgcacaaaaaaaaaatggtatatgcagagacttccatcacttgcttatgatgccgcattgggatctcattaataagacacttcctcagacacttcctttgtgttcaataaatttcaatttcctcctttccttcagttcacttcaagaaggacggcagcaactttcttgttgccaaacctgacaaatgttttttagtgctgattatactcgagcattctgtagcaaaatgctgtgggtgaaaatgccttccttcttaagggaatttagcttctgtagtaccagaatctccttgttgaatgaacatgtactgcctaagtcttagtaatccctcctttttgagcccattttctggcatctctccctttaatattcctcaaaaagttggatttttcctggacttttcatattacagactttcctttggtcatcctcatccattccgtgattccaactacattttccctccatcctggcatcttctttcttccagacttgtatatgcaactgcttccattcatacacttgaccaaccttttaatttctataagatcaaaaactcagctcacaagctttcccctaccatcgagcggggttcttcttttgcttctttgtttcagacaatggcaccaccatactcgagtaaggcacgttcatttatcaggtcctaccaaatctacaataaactctcttgaatttatccacttgttttcatttgaacagtcatttctttacctgggtagcctgcaccttctacctgcattgattcagcagtctcttcaccactggctctccctccctctcctgcctctcttcttgctccttcaatttattctctactcttcatagtgacttttattaatgcaaatatgaccttataactcccttgcttaaagacccactcatgtttgtctttgtatccataacttccggcctagggcttaacgcatagcaggtgctcagtaaatctgtggtagatgaaagaacaagttgtataaatactgaatggtctgatgtgctctttgttgtgtcaagaaggacattttgcagtcaggatagctacatcagtcctttagtaggcatttgacagcactcgcattattcctcaagagaagatggatgtattgattctgtatttcaaatgacataacttttgtgaaataagaggctgccacggtaatctgagggatctctcaagttcaagggactccacagtgctttgtgtaaggtaacaggctaaagggttcagtcttaaactttcttaagactgtagttcagggttcctatggtggggctataaccctgaattacatcctctttcatttcatgctgataatgagaactacaaaccaaggggtattaggaaagaatccaggtttgatgcagggaaaaataaaaacaactgataatctctagtgtccccaacttcaagaattcctttcttctttacaccaagctttttttctctgccaggacttactttgtcttctacatgtttaagggagaaaaatgagttaacagaaggggaggtacagcatttctatttacttagatgctagagaacaggatgaaaggtatgaaaaatatgaaagtctctctctctctctctccccagccttcccccgcttctctctctctctctctctctctgtgtgtgtgtgtgtgtgtgcacgtgcgtgtgtgtgtgtgtcataatactcaacctttcttttctttcaagcatatgttgtggcagagacaagtgtacatcaaaattcgtggtccctctttcatagtatagagttcttgctaggatccagctgcaagccagcaactacatttcccagccccactggcatctagttagagccatgtgactagttgtgaccaattgaatgtgagtgggagttatgttgcaggcataccttttccatcttcttacttcccatttgctaaccttatggaaaagagtcccaaagacctaggagatgaaaaagcctaaaatggaaggactcagagtccctgaattactgggtagagaaaagctgtttgcagatgggaatgcccattttgtagtattctttcttttcttaagccactaaaattgtgggatctctttgttatagctactggcattaacctcttacgtatacatacagctatgtgctacaaagaggaatagatacattttttaatcgttgaaaggggagaaagaaacatatttaggaggaaaataatttagtctctacaattgaaaagtgttttatgaataatattttgttttggcagcatattaaatctcaggcagctgaactacattaattttcaattctctatatatgtttttgtcttcagggtttagtaacactgatatataacagtttctttcttttaatttccaaatttaaatgtctaagtttgccttctaggcagaaattaagtcccattgtggaatgagattggatcaacacttcaccaagatcattttagttctttgtaatcttaaatgaaataagctaataaagcattaaattagcatgttgtaaaacttcgtgaagttttaatatgcttctaagtggcagctcttagcttattatctctaaagctaaagtcaaaataaatgtctcagttgatgaaatggagatgaggcaacattttatcaaatttaacaaaatattttatatctgaattataaagtccagattatctagtaattatcatataaatgtatttaaccagacatgcatttttctctaatcagtagccctggagtctttggaccacaaatgtgccttatctcaaatgctttaactgtgacattttgctttagactagctcgactacttctacagaaattatacacttcattcacattcatccagatgaaaaaaatacatgtagaaatgatcataataagtaacatttgtttaggatttcagagtttacgaagggtttttctattcactttctcacttgttcttcatgtaaactggtttggtggacaactgtcattatccctgttacctggagcccctgggtcttagggagacttcttgacttctcaaggtcatgaaggtgctaactctgaccgtgtttttattcctactgtgccacacttctcaggtaaaaatcatattgcagacactttaagagaagtacttaagaaaataaattcctccagagaattacatttaagttgtttcattaactgcagtgcataaagaaaggaaaagtgttcccaaacccatgtagtattttgctattgcttatggtaatattctgcacacctaatattgtcagcataattttccatgtaacaaaatgtcctaaatcagcaatgtccaatataactttgtgtgatgataaaaatgttctgtctctgtgctgtccaatacaacagccactagatacacatgactactgagcaatggtaatatggccagggacactaaggaactaaatttttatttaatattaaataacgtttaaatttcaaaagccgcatgcggctagtggttgtcatcagatactgcagttatagaaaattagaatttacctctttaaatactaaacctatttttaatagtaggatttttaaattaaaatagttctaagtgcttttaagtgatacgaagtcaaatgcaagatttctgttttaatagtactctcaacccagagacaatcttcatgcatccttatacatgttctttgttgccttattctagttttattttaacattaaatgcctctgttctacttgatattgacttgcttcagagaacaccaagtatagtggaaagaaacacacacatgaggacttgaggctaccaaccaggttcaactaaatgcactctgatttaattgtagtattgggatcccctgttgcatttattgaagaagaaaaaaactttgcaaccaaaaagatatttgaaagcaactgttcttcttggacacatgatccctcataaagtggggcttcctgcttttcagagacttaatttctgttcatattcatttcagcaatagtaataatgatgatggcgatgatgataataatcatgatgatgcctaagtgttgtagtaatgcttcttctgagccagacgttagtcaaattactttctctacattaattcaggcaatcatcacaacaatcccacaggacaggttttattattatacttatttagctagcaaatgatataactaggttaagttacttgcccaaggtcatactgccaagacagtggctctagtgtccctgcttctgaccatatgttatgctgcctatcctagagcttttctcttctaaaatagtaaaataatatattctttgtttgtttcatacttttttttttttttttttttttgagagggagtttcgctctttcgcccaggctggagtgaggtggcgcaatctcagctgactgtaacctctgcccccaccaggttcgagtgattcccctgcctcagcctccgaagtacctgggataataggtgcccaccaccatgcctggctaatttttgtgttttcagtagagacagggcttcaccatgttgaccaggctggtctcgagttcctcagctctggcagtccgcccgccttggcctcccacagtgctgggattacatgcatgagccactacacccggcccatacataaatattttaagcgaagtacacatgcatgatcatcatacttttaataatttcatttaactgtttccaaagaatgttagtatgaggttttctttttttctttttataatttcaacttttattttagattcagcgggtacatgttccctggatatagtgcatgatgatgaggtttgctatatgaatgatcccaccacccaggtagcgagcatggtaaccactagttcttcaacccttgcctgttcccttcctccctccttcctctgtagtccccagtgtctattgttcctgtctttatgtccatgtgcactcaatgtttagctcccacttttaagcgagaacatgcagtactcgttgtctgttcctgcgttaacgtgcttaggatagtggcctccaattgcatccatgttgttgcacaggccatgattttgttagtttttatggctgtgtagtattccatggtgtatacgcgccacattctttatcctgtccaccattaatgggcacctaggttgattgcatgtctttgccattgtgaatagtgctgtgatgttatatgtactttttggtatattcaaagagaaatgctattttcctcttgacatatttatgtcaatttaacatatttatgtcccttttctttttaggagcaccattctcttcctttaacattataaataaaatattttttgcttttctgtttttgtaagtgcagttttattgacagagtgagacatacacgtcgatattgtgactagctgcatgtcttctattatttagaggtctcactcaaatgtagattatcaaattctgttagtgaagagggtagaacagcagaactaatgctggtttccttctctagcattatttgatgataaactaagatgataataccccccaggtcttagatacctgcagtaggacaggcaccctacatttaatgctcctaggaatccttcaaagtgatagcatagttattatacagtaattgagaaaactgatgttcataagttagaaatttttccgaagttgcaaagaaagtgaatggaagaattataccaagttctggccgggcgcagtagctcatgcctgtaatctcagcgcttcaggaggccgaggcgggcggatcatgaggtcaagagattgagaccatcctggccaacatggtgagaccccgtctttactaaaaatagtaaaattagctgggcgtggtggcacgcacctgtaatctcagctactcgggaggctgaggtaggagaatcacttgaacccgggaggcggagtttgcagtgagccgagatcgtgccattgcactccagcctgggcgacaagagcaaaactccgtctcagaagaaaaaaaaaaaaaaaaaaagaggattataccgagttctctttgattccaagcccaaacaaatccttttttgcaatatatgacattgtttccctgtttgcattccccattctgtgtatcacacatcctgtggcctgatcaaaattcattttcagattctgaatttattttccattgaatctatataaactataaagacagaagatatatgtatgtgtgtatacccacgtttctcttccagtgtcaactgataaaaatagatttcaaagtctcaataacctttaattccctttttctcttaaaaattctttagaacttgtacatgacattctgactctagcagattttagaaaacagagaggccattagatattcataccttactattcagatgaagtattcaatgctaaattatgtaatttatctgctttgcaaattgtatggtcagattgagttccacaaaggagagataatttttaatataggcattctgtagcttccctaattattgaattagtttagagcaaaatccttaaattgtatcgttgctatgctcaaattttgtatacttgtccacgtaggctatattaagatttcattgaattttggtttctttctcagtgataattcaatatatcaactcaccactcagatttgcctttgggaaaatccaggccccttttctggatttttagagcagattttaaaaaagtgattctgtatatgtgttgaaattaaccacatctcattgcttttgaatgattgaggtaatgtatacctactactttaaaaaaaatgacttacttagaaggtgtccatagttttataagttccattgaactggtttatattgtatttagaaaggaaaactactccttttatccttaagggtgaaaacctggattttattatacaattaacacatatttattttttattatgaaatatatcacaatataaacgtttacagggagtgtttaaagtggtgttgtccaatggaaatataatgtgagtcaaatacgtagttttcaattttctactagccatattagaaaaagaaacagagaaattaatgtaataggatactttatttagcctagtatatccaaatcacaattatttaaatatgtaatcaatataaaaattactaattatgtatttaacctttttctttagtaagtctctgaaatctagtgtatattttacatttatggcacattgcaatttgcattagtcacatttgaattgttcaatagccacaggtggctaatggctaccgtgttggacagcacaggtttaaagaataatatgaacatctgtgttccaacattctgagtttcaaataagaagaacaccatcagtattttgggagaagctccctatgttaccccttgctaatcaccttccttccccccagagccaaaagtaaccattatcttgaatttctagtaaacaatgctcattttttaaaaaacgtatgttcaacacctgtatttgtatctttaaagagtagctagttttagtttgcctggatttgaactttatattaagggaaccaccccatctctaatcttctctgtgaattcttttctctcaatactatgttttacatatttacgttcatcaatgtgcaactcattgtatgtatataacacaatgtatatattttacatgcgtatggacatttgggttgtttttatgtttttgttcatcacaaaccacaacacacatgtgttcttgtatatgttttatagtgcatgtttaaaaatttctcaacagtattcgctagtagtattgtcaggtcatagggtatgcacacataaatagaaatgattgattagctgcaatttgtagtgcacacatatttgctatgtaagtgatccatgtttaagactttaactgaatttaaaaaatattttattggagccaatctaaatgagctaagggtttgtattgtttacataagcaaagattacacttactgggtcaattcggttgattaactttggatatataaaatatatagctagttgttaaatagatataattattaattggcattacttttgtttgtatataaaaatttcaaaatatccatgacttaagcaaggtaaacacccactgggtggcttaagcaacagaaatgtatttcttgcagttccggaagttgaacgtctaagattaaggtgatgacagggttggtttctggtgagtcctcccccattggcttgcagatagccgccttctccttcatgacctttcctctgtgtatgtgcatcccttgtagctgttcttccttttatgaggacattagacttattggattaaggtcctacccatatgaactcatttaaccttaattacccctttaaaggccctacctccacttgcaggggttaaaacttcaacatatgaatggggttgaggagacctacttcagtccataacagtttctatattctgaagatggtctttaattaactaaacagttaatgttactttactgggaatgtcttttggatgggggaataagctgatgatatgagaagggttggtgaatttctcataagtgtgaaatttgttgggccggcccagcatgattttcaatcaaatacgctttggggacaagtaggttgaatcactacgagaggtttaaaagaaagcaagttgtaattgcaacttttaattgaaagaaagacaggctttgttgatgtgccagcaagactgataactggctttaacgtagatagtaaggcagcagattcaatccactgatcgtgatctactagtgaatttcaaagccttatgcaatagaactacaaaccctttccttgcccaccttgcaggtggatccataggcaaaatgaacatttgcaaaaaagccgctatgtttcagaatttgtgctagggctttaatatctataatttctccaaatcctcacaatttaagaattaattcaacttagccccatgaatagggtgaaaattctgagatttaacaaactaaaataagttatctgaagacagacaaatagaaagagttgagatattctatttgaatgtaaaattttcaaaaagtagaatgacagcgtcaggaattacagtctcagtgttgaacacaagacttaggaacaaatttgctgcatgtaatttcattgagatgggacaaagtacagcatacgtaaggaagttttagaacaaataagataattattttacgagctttgaaacatgtgtaagaaagatacgaataaaagtataatcacatttgactaaaacatgaataccttaaaactgaaaagcactgagattatcattatataattttgaatattttaaaccacaatgctttgggagtgcactgtaatattttagaattggaattttaacttactggcttaaaaagtaatgtactttgttttaaattcaaagattatcttgtaaattcagttcgatctattgaaaaaattataaaattcggcaagaagccaaagaagaacaattatgtagctcaagataattaaattttcatgtttggctttagaaatatattcgtcgtgacatagtacatggtaatctagtgagcccagacaagtagttttctctttttgtcaaagggaacaatttgatgcgtgttcaagttgcttaaataaaattttgtatgtgctttctcatcacaagagaacaatatgatttttgaaattatttttactttataaaagaaaaaaaaaagccctcacagagaaaaaagaaaaaaatgatgatgtctttgaaaaacaaagttaatacagctttacatatatttgacctacatcagggttaatatttttcaaggtgaaacattagatgctggaacttgcaaaaacaggcaatcctcctttagatgaaacggacactctaagggttaattcattcactgagacctattgtgaagtaagccctacagagactgaaaaagttaaatgcaactcacaaaagttgctagaagagtcatgatgttaaaataaaataagtacacaatgtatgctgcaagtatacttagagccatgctaggtgcggttgagaagttcaatacaggtccaagataatagctgcttctcctatagaacatgtcttctcattggagggataagacctgtgtctatgaaacaggcgtaattacatagctctggaactatatatgccgaaataaatgagacagtaagtgttattgtactataaagaatgaagaaatcatgatgagaagtaacagttaatgaatgttttctagaaagagtaggatctgaattggccttaggttgtaagcagagtttatagatagagtagtggtatgtcagagtcactctgggtgcttaaacatacaaatccccaagtctcacccaaatgtgtcttcagatgaaaggaaaaaacaaatgacttgagctcccccgcaaagaacacgggtggtatattgagcagccaaggagtgaccagagtggcaggcccatgttgagggacaaaagaggacaattagaatatgattaatacaaatttacagtgggatgagttgttagcctgaggagcttgaatgtgaacctctgtgcaaaaaggagtcattaaatacttttgaaaaaggtgggatgggaagaaaatgacattctcaagacaattagatcgaacagtattaagcatgctgacttattaagttatgcaccttgagagggtggaatgagggaaaagggtctttatctggagtaagacaggaagaagctaagctgtaattcttactggactgtaaattatgtgcagatatattatctgtcatgttcgtgggcgcattctcagtacatagcacttgaaacaggtactcgataaattgtcaaatggatgcatggagtgatttccatgcaaaatctaatattgtatagtattagaagggggaaaaaagcatggcattatgctagcagaaatgtcatttggtattgaggatgaaacattttcaacagtttgcaaagccatccactcaaacattctgtcactttccaataattttgaaggatgttctttctacttctaccttattacacaatgagttgagtaagataaagaagtcatgtgcaacaaaacagagggagattttctgaaaggcactacaccaggaagttgttgtactcttgcttcatcttgccatcttggatatacttctggcgctacctccaggccagttcctcgttacatatgtcatttacttcccacatgctagactcaccgagttaatcattttgctgcagttaacacattttagcagagtgtaggtttatgggtgagaaggaaatcaatgatgtttcaatacagggttcttttcccatcccccttatttccacttagaactgtctctcaagtcttaatttgcctctaaacttttttcccagcttacattcttttctgaaaaatgcaacgacgatgccaatgtttgttgacctgaaatacattgtaaaacattcataatactttgagcagagcttccaaactcccatttgcctcttttatctcccttaccttggcccctttttgaaggcaatgtgatatttaatccgtttctattgatgcttcaaaattattgaaaaactggtaattgtatttttccctttacttatcagttgctagttgacaatgagtgtttgcccaaacaataaccaatcaaaaggtaaaaaggagattccagacatatctgagaagaaattctttggaagaagcccgtaaatggaatgggaattcaaacaaagccgtttccaaaagaaatactaaatggtctctaaatgcaaaaggattgctccccaagcattttatgggagcataaaaagctcccaacacattttatgacaatacttctactcaatgacttcttgtgttgacatatttgttgcactcgacgttagtatttacagcttcttatcccaaatatttacttaactgaagccctgatgtttttaaaaacttttcatctgtgtttaacagcccattttacagaaacttatttgtttcatcaggcagatatttactgagaacttgcaagtgccatatattctaaaaatgctgatgataaaactgtgaacacaatagattctcatggtgcttatggtcagggctagcacacacacttgtgaaatgatcactgatgatcaaaggcataaacactacatttggaagaaataccgagggatccagaagtatcttggaaacactagcaagtatagcagatggtgggattggtgcttcaaagaacttcttgtggaagatgttacgtatgtaccttctctgtgccaggcactgctaggaagtgctggagagaaaaagatgtgctagataccgcctctgtcctatgtgcttgtgctttgtggggaggtgagtaggataatcccagttctcatgcagtgtaatgagtaccatgacggaaatgcactccaagaactaggcagcatgaccagagataggacatttgagaaagacttcactcgggtggtactatcttagtctgggtgctaaaatagatgtgatagatgagtaagggtgacccggaagcaggagggaaagggaggggctttcagaacaacaagtgcgaggacattaaggtgaaatagagtataatagtattcccagatccttgggattgttctccattaggctaaaacaaaggtgttttctcttctttaagatttcatgactgcagattgcataacagaaggtcatttaatagacctctaaactgaaggaattcttgaattaaatcacaacatatcttccatggccagagaaaccattgcctccttatgtcgacattactaacagcaccagcacctgctgctcaggccagcgggagggttgggtgttgctgcctaggtaatgctcaccaactgatgtcctgccatgagtagttttgccaagttccacaaaaaaaacttagtgttctatcagcatctaatgagaattacagtcattagttaaataaaagaactattagataaggagcagaatgaacaacacacaatccatcagcttggtgaatggtatcagatggtttctgggtgctgggcagctgtgcatccaagtagacagggagaatatatatgtcctttgccttatgtacttgtttctctaatccaaaggcacagcaatccgtggaagctgctatgataaggtgtttagtggtgaaaatgtcttgaaagccagtagattattaaagtgatgtttttaaaaatgcagatggagagtaagtactttttatctagagtagtagttctcaaagggaggtcccgggatcagcagcgttagcatcacttgggaacttagacctgcatgggccccattccagatctcacttgaaaactctagggggtgtagcccggcagtctttgttgtgaccagctctccagggggttctgacactccaaatgttcaagtttcagaacgctactcacaggccatcatgctcggcatcacctgaaagcttgttagaactagaaagtcttggccccaccccaagcctactaaatcagagtttttgggagtagggccaagaaaactgtgggttaacaaggtctccaagtgattcttattcatgtcaaaatttgaaaagcgtcgatcgaactgttggttctcagctttgattgcgtatctgaatcacctggggagacagttgagctattccgggcccagatcacatctagaccaattgaatcagaatctatggaggcaggacccagacatcagtattttaaaatatttcttgaatgatcccagagtgtagctaaggttgagaaacactgttctaggattaaaggattaatgtgtttgagagtatgttaagatcttaggcaaatcacaagggtgttaagaactaccatcttcgcaaaaggagaatgtgcctcagatattctggtactgctttgattttaccttcagtagtcttacctattttgagtatgcttagtagtactaatatgaggcttattactaatatgttaaaatttgtcttttaattaagtgggtctaaacgttttaatctttaatctctgacccaactagaacttttctaaacattttcataatagtctccaccttgtcttctgaccttcacttatgttctttcagggttcttcgtgtgttactagtaatagtaatggcaagtgtttattgaacacttactatgtgaagattctaactggcttttaataatcacatcagctctgggaggtagaaggtagggatcctccttgcttatcaggtgagaaaactgtactatagagaagttagcaacttttcccaggtcataatatgtgacagctaaagggagcataatggttggaataaaataaatctactctagttgtaccgaaggctcatatttgtctcacgtacttgatttggtcgaggcccaaggggtcaatttccaatgcttggattcctggatatgtagagttgtattaaaaatgctaaaaacctattatgtatcatacaatcatacatatcacctaaagtattatggaaatgaatctgtattattaagggaaaaaggcctgtgtgaagaacaactgaaacttcattttaattgaaattaaataacatgcatcatacactaaaagtgcacgttatgaccccatgaattacttcaggtggctttgattcatgttacatacactaacaaatatagaagagtgatataatgcttcttaattaactactaatggaagtttactatttaactgcttcttatgtaagaatgtaaatgttttctgaaatatcagaacttttcattaggaagcacttttaaaaatagcaaaactgatatgcactatgatttccatatacattaaattgaacttgtaaatgatgttataaattatagaaaccaaggggatgttcaaattagatatttgtctaaataaatcatgtatggattgaacaaatactcattgagaaataaatgtattccttttctttcaattatctaggattccttgtttatctcttcagaagcaaaatgtcttctgtccgttttatttccagttaaacattcttcagattatgtaaataagttaacttccaatcctcttatttctgtttatctcaccactcttctaatttagacgtgatcaatatcttatctttttgcatttcatagacatcaggatccagaataattgagtgagctcaaaacaacaatggcaagaatgatgttttcagaaaactcagcaatcattcgtttaataaatattcattgcctaccaactataagcaaagtattggctaggccatgtggggtatacaaaaatgtattaaatatggctcattctccctaagaacttacacctattagacaaagtacatgcataaaaattataatgtataatagaaaataaatacaagccctagaatgcacagttgaagtacgatttgcatttattataaaaagaaagatgaattggctgggcacggtggctcacgcctgtaatcccagcactttgggaggccaaggtgggcagatcacgaggtcaggagttcgagaccatcctggccaacatggtgaaactctatctctactaaatatacaaaaattagccgggtttggtggtatgcacctgtaatcccagctacttagcaggctgaggcaggagaattgtttgaacctgggaggtggaggttgcagtgagccaagatctggccattgcactccagcctgggcaacagcaagattccatctcaaaaaaaaaaaaaggaaagaaaagaaaagattaatttcctgttagctaaatcaaggaaggcttcatggagaaaaaaatatttcaacacacacttgacgtagcagtgggatcaggctgatgttagggaagaatgaatgacattctacactgagaaagagatattcagtatatatatgaagagcagtagagaaactaacaagtggaaatagactcaatttacaatacttgcctgcctggagtactctatacgttgactgtaagttgcagtttactcagaacaatcccactttctacttgtttatcctatgtaatcatttattgggcctccttttgctctcaaaaatatccttgtttggataatagattatcactctgttcctaaatgaactgccctgtgtcctatcccagtaaaagggtgcattcgggcccttcgtaactgcctccactacatggttgattgaaaccagagcttggcattaagaagttagctgaacaatcagatttctattcttggaaaacccaagaatttcagaatagatacagaagctgtatagctttaataacatgacagagttgtagccttgaaagctatgtacaattcagaattatgagggagaagaaattgaagaaacagtagcagccgggtaaatgcagaaacaaatgagggagacacctagggggtgactgaggcacaataatggaagagaagtgcagtgaaattgcttgaactcttactgatgagatttctactgttgccttgaatccaggaccacctatatgttcattctttgtcatgctcagagttatgacagatgctgttattgaattccccagagactcccttatcgtctcacctcaaaccttacaataatcccttctatctttctatccatccaagctggcttaagtaaagtctatgatccatattcctagtaaacagagaagggaaagagactgaaggcaaaggccccaattagtaggctattgcaatatttcagggaaaaggcaatggccatcacattgttgtcccaggaatgagaatagaaatgaaagaagataatgaaagttgaaaggactgggggggcttgacaactgtttagacttgaggagtcagataaaataggaagccaaagataattcagaatattttgattttgattttcatcaccaaataagatagtagtactatgaagaaaaaatggttaaaaaacaataataataaagagaactcctccaaatagtaccaagggagggagtttaatagaggaaattaattccgtaggtgatgagagtcctgagaagccaaacgagaaaagatcaaaacaacccagggattggcagtcgcaggaagctgttctcacttatggctggggctttaagcacaaggtgacatgagatttcagaatttgaagtcgtctggaggcagctaggatcaggtggggcctgtcctgttcggcaggacctgcaaccacaggaggaggatgcgtcaagcagaaagttggaacacaagaggggattcagccataagccacaaaataccttccagagcagagagaaggagaaataccctgaattccgtattttccctgccatttagttccctgctattgccacacattgacgtattccatccagagaagtccattggcatatgagtctgggaaatgtagttcccagggggacatgatcttaagggaaatagacaatgactggtgcaacaactgacctgtgtgaggcaggagggaaaaaacaggaataatatagtttttctctagatcccttcatgcacaaagatgcaaaagaaatgtgttggcttaatgagccattctgggtggccctgtaggtggctgtcctacgaataagatttttagacaaaacagagatgacttcaaatgtcacaagaaaagtatcagacaggaattaatattgacttgatctgtcacaggcgtcaatgatttgcattaagccaacgatcttcattgttaatgtctgggaaattgccagcagcattacgactacttgtgtggattagtgtaacggattcccccactaacattcaggaaatcatgtcaagcacagagtgcctatgtaagagtggttgtgtctattcactacatttcttggactaataacacacttagccttcctgaattgccaacatgtacaaaaccagattggggttttttagttgttcatggaactatcatttattgggtagctcctgtagaagcaagatacagaaactctaattaggaataagacagtccctgtacttcaaagagctctcaggggaggcacacaagtaaacaagcaattattatcatacgttaggataataccgtcatggtgataaccactgagtgatagccaaacacatggaagaggtacccaagtctaacttggggtagtcagagactgctttcaaggatatccgagtaagtgttagctaagacatgatacgtatttctaggagggaaattttcaaggcaaggtggagattgtgcagtgacgcccagagcctggattattttggtgactgctagtatttcagaatgacttcagcaaaagttgtagagaagatagaagacaacaaagtataagcagaggccagataatgaggacctggaacagtggtttgctggtaaatgtttaacaagaggctcttggcggggagagagagtgtctgatttgcagcatttggcaaattttgttgcacaaatgctccagcatagccaatttcaagctaccagtgtgacgtcattgaatgcagaattggaaagaaacgggcagtagcacagcattgtatagttattttcattacccagatataatagataaaatatccagatggtatttaatagatatggatgcaaaatttaaatatatgtacattcatgtgcttcatgttactgaatgcgcacaacattcattatccattcattcacgtgttaatttaacaaacatttctgagcctctgctctgtgccaaacgcagttctagctgctggaattacagcactgaaaaaaaaaatttgtcctcactgaggtaagacaaacattattatgcccattttacagctgagaaattaagacatatgaggattaagcagtatagttaaaatcacacaattggtacatgaaggaatcaaagaggaaatcagctctcagattttaaatccagggactcgtttctgctataccatactacctacctagttgagctggattttatcatggtttccctatttttatcaccatgtggttggataagtaaaataaatatatgtgacctttcaaataaatttgggtcatttttcttggaagctcatctggtgtgaactttaaaatactgcaattaataatgattataataccctggaactctgtagcaacctcttttgaagaactccaaggagcctctaaatgtatcaaactaagttcttcaagtgaattagttatcatctgagagtaatatagacttttaaaaatgcattaattgtattaaccctttcaggcccatagacttaagtgtttctttctccaaataaaaatagtaatctctgtccattttctttagagaataatgaagtaattttcattgaatatgtagtcaacataattacttcaattcaatcgtgaaggattttaaaaattatttatgtctactaacttaaagacatgcatagatttcaagaacttaaaaatgcatattgcctctttgccctatgcctcataaaacaaaattatgataacgttgtgtgttacagaaaaacgcactgattgtaatgaagggtgcttcaaaggccatgaacttggaaagcaacttatttacagagacccccagcaatagcagctaaaagattgactgactccctttattttcagttatccttcagacacttttgacctcttcctgtgcctttctagtcatgtgcaatcttgtggatatctcttccttcctcttgttattttctatttcctctgtttctatttgtttctaaaaataatcatgtttgaatataggattagcttccttcccatctccccattaccaatctctcactataccgctatgttattaatcttcctgagaaatatatcaggttcattacattagttaccagctcaaaacgtatcagtggctttctagtcctcacaggctcaagttaatctgcatattctgactttcatattctgggttcatgcaaacttttcaactttccctcttatacctacttaggaggaccctcaggttccatcatgctcatgtttcaagccagaagttctcctgcctcttcctctatgtagactccacatagactatgatatcctgcttctcttttaatcctccatcttcagctcacagccacactcctctgtgaacagttaaatgattctcccacctcttacctcctatagcacttatttttcatgcagcatttttgagacttaattaaatctacagttttaaaaaatgtttttctaccacagtctcttattcatactaaaactttcaagtctatccattttgcttatacaaccacaccgttaggtcttttaggtccaagaatacaagagaatggcaaagcacgttgtttacatccacacatactgtgtaaattcaggtaattttttttaatcctatgatcctcaattacctcacctgtaaaataggtactactcatactgcagaactcttgttggaattaaataaatgagtgtattaaaaatgctcaacaagatttggcacaaaatcggtactcagtaaatgctaatcattattccctttctcttcaaagctccacaattctgtattcatatcaccctctttatatcatttgcaaaaatgtatcctattccaactctttccacctagcctcaacatttacaaacactcctggtgggaagggaaagcttttgaggagagcacatctatactcatttacttctcagggatgcaagctgccctgcttactgagggcatatgttcatagtcacaccggagcccactgtccccttatactctcaaatgggcagtagcaaatcatcttgatcggtagtaatgacctgtctctaaattttcacatgcatcagataatttcttttttagtaagtgttatcttacatatatgccaaaatatcaccattatatggaacactagctgaaagaaaaattattcagtagtcttaattttctagctaacataaattctctccattttcatcatccatttagattaaagactttactgttagctgaatattcagagactttattctgatttttaaaatttatgaggttcataatgttaagacttcaagggtgagctgtttgtgtcatttataatgcgtgactagacagtaactagaaaatggattgttgactttacaagatttctccccaccacgtccccccaaacctgtgctgctgtgtatttggcctgaaatctttacttctagtcaatctttggacctaaagcctaccagcttttagcatcctttaagattgacgtgtctctgggagaccaatagatgctaaaccaaatttcgtatgcacttggcaatataggataataacaaccatactccctgcaattgtttcctaacacagatgtaacaaattaccacaagctgggtggcttaatagacatttattctctcacaaatctggaagctaggtgtccaaaatcaaggtcaattatccctctgaaggctctggggaagaattcttccttgcctcttccagcttctggtagccccaggtgttccttgatttcaagcagcacaagttcaacatctgctcctgacctcacataaccctcttctttgtgtgtctttctgtgtccactcttttctttattattattattattattattattattattattatactttaagttttagggtacatgtgcacaatgtgcaggttagttacatatgtatgcatgtgccatgctggtgtgctgcacccattagctcatcatttagcattaggtatatctcctaatgctatccctccccccctccccccaccccacaacagtccccagagtgtgatgttcccattcctgtgtccatgtgttctcattgttcaattcccacctgtgagtgagagtatgcagtgtttggttttttgttcttgcgatagtttactgagaatgatgatttccaatttcatccatgtctctacaaagaacatgaactcatcatttttttatggctgcatagtattccatggtgtatatgtgccacattttcttaatccagtctatcattgttggacatttgggttggttccaagtctttgctattgtgaatagtgccgcaaaaggacaccagtctttggatttagagcccaccctaaattcatggtgatgtcattttgaaattcttaactaattacatcttcaaagaccctatttccaaatctggtgacattcaaggtttcagggacatgtgactattcaggggaaactattcatcccaccacatcccccttgaaaattctggaaaatgtagtaataaaggcttctgataaattagtgtggaaagtattcacggttataaattactaaaaagtctcactgtgagctcttaatcaaaaggccctataaaacatttatttgcttgattaaaactacacatccgatattttggttttggatttattattatttttagacttggaataactattttatgtgaaatagattccataactgaagcagcatacctctcaatttcccaacatttattttattattttttgtcttcacactacttaataactgaggaaaaatcatttagaccaaagttcaccttggttgacaccatccagacagctacaggaaataacaatggaaactaaatctctaagaaaaagagtctttcatgtgaaatattgcagagttgattctagatatatagctgttggaagaatggatactattacatagatatggcagagtggtatccagcacctttcaacaaagatctttcagagtcagtcttattatgtctggagaatttacccagggcttaggtgcttttactgacaatctaaccacctgcaccccacccaccgtctaaagctaaagtttattggaagacttaggaaatcagtcttcggaatgtttctgagactggtacacccaccacttcattaaagtgcttcacttcacttcattagacaagaagtaaaatacttgtcaggaaattatttatagtaccatgtatatgggtatcttatttaatactacttaatgatggtactacaagttatataaaatggagaaataagtcatcaagtttgacaataatgatatttgatattatcattatcttttttattcgttcccacagaagtactctgttattggtttagaaaaatgatatttgatataataaagaaggaaaaggtggtaatattctttattttttgtatctttataccccagctctttcaccaatctcccccatctctgtagttctcctctggtgtccccaggcagtgaactattcccagtggttagggaacatctcattgagtaagttacatcaacatttcttcacatttcaggacaacaggaacagtgccaaatcctagcccattgttcaactctcaagccttattatcctaataacacatccatcccaagaaagaattcatcaagatcagagaggaatacgtataattttttatagtacagtatttaaaatgaaacagcttttggcccgcgtggtctcagtgggctcaagggggaaattcaggatgctagctcatctcacaccaagtttaataaagggtgtcctataaaaagctaatttcttgctggtaaattgctttttaagtaatccttgctgttgcaagagacccattcatagcgctgacactgggagccatgttggaaaggctagatatgctctgggagataaggtaagatccaggtggaatcttctctttacagaatgacaatgtatatagctaatattgtcctttgaggctagtttgcatgcagttgctggtatggcactgctcagcagcctgctgcagataagaatgagtgatgatgccctagattttaatggaacttttagagtgcatgcagcagtggggtgcagtcttcagcaaagaaaaacgagctgacttgcaggcatgagagatcatcaagaaagataaagaaataggacatccactctaggttaggcaaggctttttagaggatattatggaaatgagcaagaaccaatttaatttttataatgccactccatttaactttaaaatacaaggtcaaggtactgtgtttttcataatgattaaagatttggagcactctttctgttgaaacatactgcatctgtttggcagaaaaaaaaagtgacaaagaataaaactgggatcagagaacaacaaaaacatattctgtcacttgcctaacacaagttaaaaagcaaaggaaaaagagacaactctgatggacatgttcatccttatcccaacagaaggatttatttacctaaggtcctattatttcaagttactttgatcccaggatggtaacataaaatgtacattttaaaataaaatggaagtataagatcaataaaaaccacatatctgtggataaaacagcagattcaatcttgtggctgaaagtttgctttaacccaacatttggtaaactattcactctgtaatttattaaaagacatactgttattataaaactatctcagtttgcatcttgttggttctgtcaaaatttcatcctgctaattctcaacttgtaatatctctgatatacatgattaatctattttaggaataaaacaaaaactacctttatcttacgcatttctaggaagtgtttttagatgtaaagtaggggtaattgtagtatagtggaaaggattttgaacttgaagccagaacatatgtctctgccaaaaactaggtgtgtgaccttaaataagttacttagcttcctgaatcttagtttgtttagcttttttctataaagtggcacacctatccacatcacagttttgttgtcaaaattaaataaaatactatattagaaagaaacttttagaaagaaatttataaactgaaatgtactatacaagtttaaatcattctcattattttcttaccctaaaattttgaccttatttttcttagcaaatggctgaatctgtaaaatttaacccccacgcagcatctggattcaagagaactacggtcatttctttatacagaatactaattatacacatatagcaaaacacaagttttttccaactactctgtgtttttaaagattcagtgtgggcagaaggaattttatcaactatgttaggggaaaaaagtctgaagaaatgaaaataatgagaaaaagcactgttgatttaagtgcaggaacataaaacttcaaggcaaatgtgaggccaactgagttcatatatatcctcacaaaatgatttagttaatttaaaaacttttctaataagcaacacaggtaatcccaaattctatcttttatagctctaagagtccccataatttattcagcaattatttaccacccacttattataagaaaagccctgggataagtcttgagaagaaactaacaaaaacaaaacttgattgtttgctctcaaaaagctgggtctaaaataggcaaggtaagattttgttttgaggagcccgtattttccagcactgtccattgtaacattaaaatagtttgccaaaatcctcactctgtgggtgtatttgcctagggtgctaaaattgcttaaaaactttgttatttggctaactaaaatcactgaatagtaaacagtagcattagagatggcagagacattaggtgtcatgcagttcaactgcttcacctagcagacaaagacattaagttccatttcttaaatttaactatctggttgaggatacacagtagcagagctaaatcaagaacctcttggggttagagtttttgtttatgcattactttgttttggaattaaaaacagtgcctgtttgctaagttaaattgaaaatatgctctgaaggagaaaaacagctataaaaatagacttaacttccaaactatggatcacaataaactaaagaaataatttctgtagcaataaactccaacactttccataggaccagaaaggcttgagaaagaggagaacaaaaaaatgctttggggcttaccatatatatggagaaagctaaatgaataaaccagttgaaagacagcgagttatactagtaacaatattactgatatcggagctctcacttataaattgtatattatgatcatagtgactaggtactttatatctgctttctcattccttcctcacattaattcacatgtaggacagattacctcttctgtttctatccagaggcctagagctcaggccctcatcgaagacagacagagctatcatccttattctaaaaaaaaactaagaccccagacatagctgtgctacttatagactagaatgtgagagaaaaagacaagctttcatcatgggcttaacaaactgaaacacttcttcaattttgagattgagaaacttagctaatgctaggtgtaaagatgatatgctaccttcataaccttggtgaggagaaattagcatttctctcagtcctagaaggaggatgaccatgaaggtcttcattctcttgagaagataatcaaatgcttcactgccctgttaacggtttactcaatattcaccaagaaaagtagatgggattatttttgcagacacttatacgggtaatttattctgataagcagagacatacctttagtgcataaattgttccctttgtgctctttgtaataaacatcaccatagagaacaaacacgaagtaatgacattgaattaaaagacaccatagaggcaacagcgactggaatttgtgaaagtaaaaggatagtgcaaacagttgtgcgttgcattctgctctgaagattaacaagctgggtcaggctttgaccatcatgatgagcaggagatttttctaatggaaatccccaatcaagttcctgctgcacccagaaaggaacggcttacagaaatcttacatttctttgcacataccaaattgcttggcatattctatcacaaggtttactttccagggaatgtgatcaagaaatcatgatcctaattcctagttaaccctcaaagtttctcagaacagtcagtgcatcactgtcaacttttgtgcaatgtggaaatcagaattggtcacacgtttttccggccactgttttagattcatataatattagtgaaatcatgtcagactggtatagccatgaatttatacttcatgaataggcactcaataaatagtggattaaatcgaccgatttgatttttacctccaataatttcaaaaatatcattgaagacaaggttgttgaagctgtcacttttcttgctgaacctttgttgtgccaggaggaacagatggtaaaatcaaaagtgattagagaatcagtggggtgggggtgagattggaggggagaggtcttcccagtgagacccgctagcgtcttccctgagcagtatgttaacccaagacaattttagaaatctgtgcccctaagttgcttgacatccaaagcacacttgatgcatcctacatttctaaatatttttattgttgtttctcggtagtaatcatctggtttagtcactctaaaagtcaaggatgaaattttaaaatgcaaataaaagtgcctactttctctctttccaattcctttttgttttattgaggtataatttacatgcacaaaaaaatcgcctttttaaagtgtacagtttgatgagttttgacaaacatatgcagtcctacaaccacgtccgtgatcagaataggaaatatttttatcacttcaaaaagtttccttgtactcccgttgcagtcagtctcctgccccaccccagcccctggaaaccactgataggtaaaagcacttttaatctgaaaggtatttaatgtatggcagtgtcagtggtaataataacaagatttattcattggttcactgtatttttgagcacttatatgtgcccgttgtatgcaacccattatgctcaacccctgccctcctcaccagggataaactagtggcagagatagacaaagaagccgtctctctatcacccctatcttatagaacattcttcaatgttagaaatgcagtataatgtggccattgagaacttgaaatgtgcttagtgggaatgaagaactgaagttttaactttatttaatttcaattaatttaaatttatatagccacatgtggctaatgactatcccactggaaagtacagcttctatacaatatgataatatgatacattataacgcaggagtttaaccaagtgctaaagctttactatcaccagggtcactggtgttatgtgaaaagaaaacttacaatagaaaaataaatcctttaaatagtcacagacctgagaaagtttccttctcaagggaacacacattggctcattcaaaggaggttaaaaactagcatttaaggtaatttcatgaagctttcctttggatttctcatgcttattgtatacataaataggcaattttcgatgggacctaataaatcactgttttttatttgaacattttaacaaaattatcaaacagcattgcatttatgttcaacctatttgttctgagaaagacaacgattaagtagaagtcatcaaagttaccagaacaatttttgttcttatgttttagaaggcattgaaggtgtttaaaatgtacacttatagagtcagagtactatgcaactgtggcccttatagtttatccgtcatgcatctaaagccattgttacatctgtttctaattgtgcatggattgtccaagatacacaattggaaattccattttatttatcaatttgaagaggtttcacccatgtggtcactatgatcactatggagtcacattaaattgagaagtctccagaagttgcagtatttatttaaaattctaactttcttcagaggaacaaattctccatttctggattctgaatcctcattagccataaggttgttgtaagaatttgcagctaataggaacacatcctggggagagaccagttgaaaagtaacttggttctgagtgaaattatacagagacagtttctacttcaggtggtgttgctaatgaagctatcatggtaattttagcccatatgatccctaaacgacttcagaaccacttttcatccactaagaacccacttcaaccactgccacgttcactaccacagtataatatggaacaccctctggaattcagtaagtaacttcttaactcattggctatagagctttgcctttgtaaattctttccttttgcagtaaaagagattgtttcaaagtaatccaattagtccctaggcatgtctagaaaggtagagtcaacaacagtaaggtaatagtccttataagatatgtaagaaattatcagtcatttactttaaaataatttgtacacttttccttttatatggttcttctatgttgaagccagtggtcatccagtgattaagattagccaaactcaaaaggctaaaactaaattcaaatggtattattttgctttaattttatgcaatgctatgtatttaaatttcatgaaagtttcgtatggcattgctatcaatttcagtcaggataaatttcccgtgaaataatccacaattttcaactgtacgttgggtacaggtaaggaaacacccttaagagcttatccagttattagctggtattataaatttcaagtaattcaatgttcaattaataaacagttactttaaatgggaaagtatgagtcaagagttagtacaaaggagaatcttaaaagatgaacatcaaagaatcttactattgatttgttggtgcctttgcttgcacttctccaaattgacttgacgttttaaatttgtactgataatcatcagagtcaaatctgcttttaggcaaaaagtatccgctagttattcccctactatgaaagtgatgagatgaattgatcatgtctccagtgtatggatggatgtctttgaggaagacctactgaccttatgtttatcttctgtcagcatggtgtgactatgtggagagacagtgctatttgctaaatactttgtttttcaaataaaaagatttcacagattatgcattgtagaatttataagtattcttttatgtctttgaatgtgccaatacaatttttatgaagttggaactattttatctattttaatgaaattgtaagccttctgtgaattcttttattaattttattctgaagaaaatctgaccaggttagggaaatcaggtcaggttacgacgtgatcccagtggaaaagctgaactgtggactgtgatttaaaatagggaagaggtactgaagtgttgtttttatttttgtttacaaatcagcctttctaactattatgtactcccatccttctatctttttctccaccagaacgtattaacaggcatgcatataattaatgcttttcttgagataatattaaaattaacttcatctgtcaggccgtctgggctaaaagtacacagtcagatctgggtaacatttgagttgatgtaaatatgcccacacatactgacaatgcttaccatttattgtgtgaatgaaaagcagtgtaaatattgtttgttctactagggaagctccacattttaatcaaactttgaccgtatttctaaaatgccagagcatctggaattgttaaaggaactgatagtttttgtgtttttaactgttaggatacttgaaatccaaagggtaaagaaactcagctgatttatacgtttcttcctctttattttaatgtgataaaatgtagtttttgtcatgggctgacaaacagtggtagactacactaactctgcgtttgctgggtttaatcttaccctctcaaggcatggaatgggagctcacttcagacccagccatgcttcactgtccactgccttctcatggatatagtgtgaacattaattagatgaattccataaagtgctttaagctctttggagaaagatactcgctgcataattattcttaactcccatacgctcttatgatataaaccattctgccaggaaatcctttttagggattatcacttaaaatgaaattttcattattaaaagcaggaagaatatacatctactgacagacgaaaatgtgcttaaggcgactgcttttaaataggcagaaatcctgaactatggagccatccatgcctgaaaatactgagtaataatgaaaactggtagcaaatttggaatattaatcatcacattaagttgcaaagaaaaaaaaatacaagccacatgccctttaaaaatacgtgcacaaatctttattctagaaatatataactttaggcctaaaaaagtacaaaaagtaaattattttatggctctgaaagtatccttaatttactcaggtgacaacaattagtgtttaaagagttagttttcaatcttagctacaagttggaattactctggaagctctaaaaaaacaaaaaacaaaaaaaaatagagatgcctagttcccacctgcagaaattctgatttgatttttctggtgcgagacctgagaataggaatttttttaaagcttccctagtgattctagtgtgccacctaggttgccttaaggtaaacctcatattatgcagaacctagcaatcacctatcctgattttatagacgaagatcataagacccaagagggcaaattgatttattcaagattgaatatacaaatgatagaagattcacataagatgcagtatacagagtggcttgtggattcttgccaatgcaggcagcagaattttctttagggttcacccagttcaggcacctctttgcagcagcacttgactaaggttcttctgattggatcattatatgggcaaaaagaaaaagcttaattgaaaagagctgaacccacattgtggaatggaagatatacagtttacacgttataaatgattaatattcatgaaagcatactgccctttcctcttcccttcccatagatgacatcattgcattggtgtagttaggttggtggtttcttgttgttgatcttggttctgacacagttcatcacttattatcctggcttattatctacttctacattcattgttcactcactcactaattaattcaacatggtttttattgttttggaccggttatatgcctgcaacgctacgtaaggctgaggatattacaatgaacaggaaacaaccctgaagtttaaggtatcaagcctttgagttactgtcttttatcatagctgatataaaattgaagccccactttttttgttttcaattactgaaaattcagtgctaaaaaaatgtggatttttattcaactagataaagtactacaattaggtttccactgaccttggctgtttttgttcccagttgccattacataaatctgtgccactcacaacttaggaagggtgtaacattctctgtaatagtttgcctttcgaatagtgtttggattcattactgtccctcgcagtttggaataatgaccactgaataatcagtgtttggagactaaattagtgctgcaaaattccctcaaattacctactgttcttttccctgtcgatgtatcctcatattcactatgattaccctgagaagaaagatattgttgagaaccactttacctactcgaagttttggtatttcaaagattcatacttatgtcatgttgattacattagcactaatactattggcagaattctaattcacgttattttctttttttccaatttctctccatgcctatgtgttgtcccttcgcagctataaagccatggccgattcatgggtgcttttgttaaggcgttcagcagtcacgtttgtagatttttgaatgggacttagagcccttttttgttctttatgtatttctctatttctcagcaaaggaaatgcagacatgcaagaaatagtgatcaaatgtcctgtgtactattgtgggtgtcattaatggtatagggagaaatagaaaatagttgcaaagatgcatttaacaaataaacgaggtcttgagattcaccatgaatgtggccccttctatgaaaagtagttaacatccaactgcaaagttgtactggatcagtttgactttaacctttagctaatatgaaaatatggaattgtgtggtggtgctcacaaaaaagaaaactcatttttcttaattatcatcaattaacatgtactgactacccatgagggaaagttaatttgctcttgagtggaaccagttatttgccctattatttctcccttgcttattcccctctccctccctcctccctttccattcaacaaagaaaaatagataaagcaatttctgattagccagtgaaagcctctaacataaaatttccaaagatgtgccataaattatccacaaaatgtaaaacttttcaattttggtttgcattttcttttttcttattataaaggtaataagtgctcattatagaatttgaaaaatataggaagttgcacggaagacgaataaaatcagccataatcctacaaacctattgacacttgtacatatgtttgttatctctaatgcattcattatgataatgcatcttttcaaccaatagagtaatcactggtgactttcaaatttgcctactcatttttcactctgtggacttactttactacctcttgccctttttcagtaaatgaataaatatttaagtaagtaaatacaaatgtaataacttatgcgctcaagcacacagatacacacagagagaatttggaacttcggaaatgccatcctctccctagggccgcaagtgagttgataagcacgtaaggaaggataatcaggggagccttctcgtattgcccagatggctcaaaattcgtcatctctaccaaacaactatttggagctttgaagaaatatccatgacccctttgaattcttcagtttctttcgcgttcactttgagaaccaagtgacaagtgaatttcctgacttggtcttttaaacctgttagcgcagttccattgagattttgtgggcacaagattgcaatgaagagatcaacagggagaaattcatttccctatatatgtgcgattaatccggagtgctaagggcagatataaagcaggtgcctactcctgtataacttggaataaaaccatttccaaaggctgatgatcctcaagtcttgttctgcaaatgactgatgtataacttcaggccaatttttctccagttagtctgtgtcactgggagtcccatttctcggggagcagccccatgctttgtcaggtgcggagcccacagaaggttaatgcgaaaagaaggcctcttgccagactgttttccagatgatacgtagggttattagtttgagctccttaagaagatttttctcacctgtcctaccaacttatgtttatttcattggtgttagagggtttcagtggcggaagtaaaatatttagcggggaagggacagcgttcatgggaattttgcctaacttaattttgtatctttagctcattcgtagtcattgtactttgtgttttgtcaactgaattttgtttgcatacaaaggcacaaaatgtttgcttcagacctgtcactcttatttttagcatggttagacaaaaactgagatgctttaattgtctaacttatcccagtttaagtgctgcaaaatctcccaggcaatgtcatgggcaactaagggataaaatcagagatttaaaggtgccaggtttcccacgcttctaacagttggcgttttgggtgtatacaatccctcagctttcttctttagtttatggagtcttgtggagggaatagcaggtttttagctaaaattatcatgctgtcgagttgggtctctagtgcatcctgaagagcttgcattatttacagaggctgggctatcattttaaatcctgatgcttcaatgcccgttatcattcttgacaaactcttccagcccgtggtctgttttcctctgtttgcttccatttactttcctgagcaaccagctgagcaaagatttacataacttttgtttaaacaaaccctgtacagttcactctttcagccagtatgtaaacacttttgagacacagttacatttttctattttagtcccagattctgtttatttgctacattttttgtgcccacatttttgtctttgttaagtctcttacagattcacatgaaaaaccagaaaccgtggctgctcaaaagtcattaataatgagatttttagctactgtttctgcttgtaaattcttcatttcacataatacagtctcaaaaggccacagagaattcagcctcgcttatctctgtgttgcagatgatggcttctagccttacccaatcccagtgcagcttgcttgccatccaggagtcgaatttgtttccatctgacattagcgtattaaaaagattggagatcaacaagcaacaatgttcttgtagaaaggtaatcaaggtttagagcctgtgtgtcatgagactcctagcatttgaaaccgctaaggggttgaccaccattgtcccaagcacctgtttaagattctttcctatgataagggacctaaagtgattagcatactgataagattttcctagaataacctatttatttcagtattattctttcaaatcttaattaccatcttttcctttacccagggtcttctttctacctctacgacacatttaattacctatattccccaacctgtaccatattaaattttgaatggaagttttatagggtaatttattggaaggatggccttgagtgtcattatgttcaatgaatgccctattttgacaaagagatgactaaatgttattgaaatctttttaatccaccacgcttctgcttagatgtaaatgcaaatctgttctttacatttgtgattgaattgaacttgaaaagtaccgccatattgattccttctgcaaataaaatataattacatttccctaaactttctacactctcccaagagattggctggctttgtattgtagatttttggtgatcacagaggacaatgcattatcataagaccaataagatttatttttaccttggtaaagaattttaatttatttctagtttcattttcatttatatccatctcttctcaccctctgctctacaaaagtatatatgactatataaattgaaaaaaatatcaagtgcaaaattacagaaataaataattaggttattttagtggaggaaggtttgttgtgggtggaggaggagaggagtgagccaagaaaaacgagggaccatacgtgatcatatttttgcagctattttaaattgtttgtgtatatactttaaaatattataaaataaaattttaagtgcaatgcatatttggagccaatgatgagggataacttcagaaacgtagcatcatcatctagtgctttcatagtcctttcaacatttccagatagttttaatggcctgctcatggaggcaatgccctaattttaacatatctcttcacaactctgatttcttgcttcctaacattaaatgtcttcaaagcttctttcaccactaattccttatcaagaggataagccagtttattctttaagaaaaactagctacacaaaaccgtaagtcattccaacataaatccttcactatcctctctctatagatttggttttgattcctcctgctgaaattcaaccttctttcttcagctatccacacgtcttaccctctaacttccctcaggagtgtctattagctcccattacagtgaccacagtaatatagtaatcccctgctgttctcactctccacttccttacactgcgttttaagtctcttcatattctttatcaccttgtatcatgcatcggttttcttagttgtttattttatgttgccttcataaattccatgagagctcactgccgtatctttagaacatggaacagtgcttggaacataatgggcattccttaaatagctgtagaataaactttcaaaatcaacaataatgtatttgccaaatccattggcttctctgccattttatcttgttcaataccactgcgatattccccttcctttttttttttttttaaagtctgtaaccctttagcttctgtaatattcctagttttttattcctctcatgtgtcaaaatcatcagttgaggcttattgttttctctttctcactctgacctcacctttgtttacatctcatcttctggctttggctatcctgttttttatctctgttccaacctgtatttctagccctactacctggacatgacatgtggatatctccgtatgaccgcagtttccatatgactttgcaaattcatccctgctctcccctccaaagtcatccccacaattgacttcctgttccttccaacctattaaggttcaaacccacttttgctcctcctttgcaggctacacttttccttctcagtacctcttttttttccaagttcttagataaaagtcatagtaccttacgttgtaattgccactggtctggtctttctgcctgctttcctttccatttgtaatcacattatccattccaatccatttataatactgtgatcagccataaaaataacatttatcatatcgtttgtctccttaaaacctgtagtagatcccctctatttacaagatctggtataaaatcacccttcctgatattcaatgcctgttttaatataatctcaatattatgcgtcataaatccccctgtgttcttgcactttttatttcttatacatctcatcaaccatgtcttatcaactctcaaaacctgtattggttttcaggaaaactcataaattattcttttgtagaccttttgtttgtcatctttgaagatctctctctgaactacaatattttgtctgtataatcaatttggaaattcatcaggtattgaaatatgacatgtcttctattgtcttgaacattaattaaaactttatttgactttttatatgcttacatcttgtttcctcacggagtgttaacctactagaaagtaatagtttaatcttatatttattttaattcagatttagtagcatactttacacgtggtaggatgtgtaactgccttacaccttgcttacgtgagttattaatgttttcgtatatttaatctgaggatgtactagcaatgttaaaactgtaccgcatgaaattgagtaattgaactatttgttttaaatgtgttgcttaacttattgtaccattttctcataatcacagctcaagttaactttgtggttgtacgtattatttcttgtgaaatgccaacaaacttagagcaaggaaaataacaggtataatcatactataaaggcaaccttaacactagcatagtctcttagctcatatggtaactacaataatgtacagtgacaaagagaatattgtactttcttagcacacactttcctactactctactgttgtggataaaaacagacatactttaggagaaactatgttatttccaaataatgccttaaaggttactccaggaaaaggcatttacataaactatctaggaaaagaaccttttaaataatataaagagctcacccaaaaggactgaagtgtttagttgaaaaaaagtaaaaatgtcgaagactttgaaaaatagtttcttgcagtatattttcatcgcttccacttacgttatgaagacattaagcgctagtttatcaaaaactatttttgtacatgtcttctaatgacagaacaatgtcaacatgattttcatcattgagaatgcgtaaagaaaccctttgtacagttttttctatgaatgttcccctaagattaaagcaaatttccaacacgaattaggcactccgaaaggaggaggggagggaggggagcaagtgctgcaaaacttcctgttgggtactatgttcactatctgggtgatggaatcaacagaagcccaaacctcagcatcacgcagtatacccttgtaacaaaccaacacatgtacccctgagtctacattaaaaatagagattaaaaaaaggaaatcagtatataatctaataaatacctctcaagctttctcatttttaaaataaaattttagattattattttaggaataaaataggctcttcattgtatataagttcatttctgagttgcaaaaatcctctctttatgtttttttccccgtattagcatgtttttctcctgtttttccccactcaacttggctgccacaatcagaaagcacaaagacaattttttcttgcgcttgtaaatcaaaaccttagcatcagacaaaataactgctccaggtctgtcaaatagattcatttgagctttcttcatgcattgaatacggcagaatttctgacctgaagaaatctagccttttccaaatttgctttaagaacattttgcaataaatttaatataataaaaggaaaaaacacatcaggctagaatttggaaccgattgttattaaaaatctcaagtctatcaatttaacttcaacaaattacttaatttctgtgatggttaatttcatgtgtcaacttggctgggccgcagggtaccgagacatttggtcaaacattattctgggtgtgtttatgaggctgtttctggagagattcacatttgaatcagtagagggagcaaagccgattgttctcccttgtgtgggtgggtctgatccaatcaattgaggacctaagtccaatcgattgaagacctaatcaaaaagcctgattaaaaggaactcctgcctgatagctaaagctggaacacccatcttttcctgcctttgagcttgaattgaaaccttgggtcttcttgagtcttaagcctccagttctggggctggaacttaacgtcattggctttcttggttctcatgcctttggactcagacaggaactacatcattggctttcctgggtctccagcttgctgactgtaaatcttgggacttctccagattcgtaatgagccaatttattacaataagtctctccctctctggtttcgagagagagagagagagagacagagagagaaatgagagcacaagaacgtgagtgtgagagtgccctaatataatttctctaaatatcactggttactcttcaaagttataaaattggtataaaaggtgacctcaatttttcatggagttaatgtatgaaagtcacaattaaaaaggaagaattagttctggtgtcctgaaagttatttgaataaattaatatgctatggaggctttaaaatactatgaaaatttaatattgtattattcttagtgttgctatttttaaatagcactttttcttttcctttttttttttttttttttttttttttgagatggagtctcactctgttgcccaggctggagtgcagtggcatgatctcggctcactgcaagctccactgcccgggttcacgccattctcctgcctcagcctcccaagtagctgggactacaggcggccgccaccacgtccgggtaattttttgtatttttttagtagagacggagtttcaccgtgttagccaggttgttctcgatctcctgacctcatgatccacccaccttggcctcccaaagtgctgggattacaggcatgagccaccatgcccggcttaaatagcactttttcttgtgagtcactttttaaatatttgtgcaaaccttgttgccattctactcaagctaatatcctaaaccgaggacattataacatttcaggagtcaaaacttcagacacttaacatagtatcctcaggttcatccatgttgtcataaatgacaggattttattcttttatatgactcaataatatcccattgcatatatatgcaatattttctttattcatccattattaaacacttaagttgattctatatcttggctattgtgaataatgctgcaataaacatgggaatgcagatatctctatgacatactgattttatttgctttgtctctgtccccagtagtggaattgctgtatcgtatggtagttctatttttaagttttcgaggaacctccataccgtcctccataatggatgtactcatttacattcccaccaacagtgcataagggttcccttttctccatattcttgccaacactttttatcttttgtattttgataatagccattctaactggaatgagatgatatctcattgtggttttgatttgcattttcctgatagtgatgttgaacattttttcatatgttgtattaactaagccaaacacagaaagacaaatgcagcttgttctcattcatatgcacaatctaaaaacatcgatctcatagaagcagtaaatggacggtggtcaccaaagaatgggggaagtaggggaaaagcgagaatggggagaggattgtcaatgggtacaaagtcacgattagaaaggaagaattagttctggtgtcctgttgcatagtatggagactattgtcaacagtaaggtattgcgtatctcaaaacggctagaagagagggttttgaaggtttctaccccaaataaatggtaaatgtttgaggtgatatgctaattttcttgatttgatcaagtaaaggtcttaattgtttggcaattaagactcatgaatacaaataaaggtcttaattatttggcaaagcatgctgagttttgtaaacaattcagtagtgatttttgagaataggtcaatagcaaatattaattaaaatgtcttctatttatgacctacagctagatggtaaacagatagatgatagatagataactgatagataactaatagatgacagataaatgataaatagataaatatagataatcgagagagaatacctttcccttcacacacgtgcatataggcacactccatttctatcatagttaccaggattcagacattttgtctcactatttttctcaatgtgaacatgcatataggaatattatagtttttgttctgtgcccattttagttcgttttttaatatttcaggacaaaggcaatatggcggtttcactttgtttttcatttttgcttatactttttaaagctcagtgtagaaaagtttgaaaatacacaaaagtattaaattaagacagctgggcacagtggctcacgcctgtaatcccagcacttcgggaggccaaggtgggtggatcacgaggtcaagagatcgacaccatcctggccaacatggtgaatcccgtctctactaaaaatacaaaaattagctgagcatggtggtgtgtgcctgtagtcccagctactcgggaggctgaggcaggagaatcgcttgaacccgggaggcagaggttgcagtgagccgggatcacaccactgtattccagcctggtgacagagcgagactctgtctcagaaaaaaaacaaaacaaacaaacaaaaaagcacctatagtctttctcccataggttgccttcttaatgggttttacaccttttgatgttttcttgagttctgtcccattagcaagtagtattgtacaaaaaaaattttatcatcttttatttaatattttattgatgtttaataattagaattattttaaattttatatgtcattttaaaatgcaatacaatatagtaaactcccagatgtgattgtaaataattaattattctcccattattgggcattgggactgcttccacattttggtcactgcagtgaacatccttgtacatgaatctgtatgttgaagttgatttcattccacactccccttcattcaaggggctccaaccattctcgttttctttcagcttctttatatccaggcatataaagttccttcctgactcgggagcgtcatacatgctgttttctccatctggataagtagttaattctgttcttctttgtgcatctcccgtttcagtaacttcatctccaaagcctttccaggtcactttatctaaagttacaccataatcttgcaaatcctcaactattgagcattattagtctccgttatcattattctccattattctctgtgaaagcatcccgtgattttcttttgtccctattaccacaatatgtgtttattccgtgtatgtacatctttgtttgtttattgtttgtctatacctgcaatgaaatgcctaaggtcaggaactgtctgatgcaggatgcaatgcgctcaataaatatttactgaacaaattaattcatttgctcagtcttgcaggcaaatggtacttctgtatatttaaatatctaaaatgaaagcgttactcgttactgttggttgtcaatcaaaatttaaatgtcgatgtttaagcgtgaaagacctctgtcaagttaatctgtacttacccaaaggctattatgtagaagcgacataaatattttcctaaatgttgattttcatattttaagaagacaatgaatgtttcaaagcattttcttctacacagctatttattctggagagtggggcatatgtttcttaatattgttaaaattggcaaggggatactgttgctatatacaaagaacacctaatcatcatgcagacgttttgtttctggctctcagttatgaaaagcagagattttaaaaagttacctttatatgctaaattaggaatggcagaaggtaatattctaatgtttataagtggttcttctctgagtccttggtttctatgtttatgaattctctttttgaaagaaattatagttattattaccaggtctattcttttacattgtttctaattctatggtgatcttcaaaatagagtatcaattttaaatacttgggaatgaaattattcttcccatatcatttctttgtatggcatacattgtgatttgttgtcccatcattgtttcagtatgacctgttactgcaaaaacatattgagataaatcatcccacatactctcggccaggacagacatcacactgttgcagcaacacttcagatgagccccattcaaccttgtgtttttatagagaaggatgccacatgtttatattcatttctgaagattggctcatattatttattgaaacatactagtttaaaaatctgtccatttatataacacctggtctatctacataacttgaattacataaatataaaactaaacttcccctcttctccagtgtatagcttgcaagcaagtgcatgtgaaataaattaaagccttgtttgtgtttttttcatcatgtgagtacaagacttttcaataaaaatgaattacttttgaacatatttgtttggacaacaaacaagagaaaagatctatttgattgatagtggacagaattttcattaagttcaacagcagaaataccacaattgcatcattcaccttcgtgtatcaaaagaaaacagaaaattagatgtgatgaactctacacaaatgttcactatgcatactttacccattaaatacattatcaagaatcatgtcagcatgacattctaatatagcagctttacaaaaacatgtaatctaatctagggatgctgttgtcctctttaaatcagcttcaaacatattctgggttgatatttctcattcttttttgatccacattgtttattcacataatgattatatttaactgaagataacagcattatcaaagtgaaagacaaaatagatgtttaataggaaagtgagtatcgaatcatcttttttctaccaaaaacatctataattatgaagtatttggttaattattttcacaataatttaaaagtgtacaacttgccgatttttttgtactttctacttttcatgtctcgcatatatctctttaatatctaagtatttgagtcagaaaagagccagtaccgaataatgggaatctcactgaaatgtgataacaatctggggcctggtcctgggacctttatctgcaggacaacttggacaaatatttagacccccaattcctcgtctttaccctaggaataataacacatttttctgacctcatacttcacgtggatctcaaatggaacaatcatctgatagcactttatgaagtatatgaaagcaataaattatcacaataagataattgcaattattctttggcatagtattagtgatgtctttatctgtctgacaaaatcaacatttctgtatggtaactgcctttccttgttttaacagaagatcatgccagaaaagatgagtaggtagatacttaacttgttgttcctgaatctggaatgtattgcagatgtcccagactgatctttgttcttttttttccttacaaatttcttttcacattgacagtgtgatatttctttaaatgtgcaatacatagctaaccttatttgtttgtgtttactaattaaaatatctaaactgcttaaaggagaaaattcagttttaagttttattgatttatacccttcttcaatccacataggattagggtagtatgtaacaaaatttcaaactataaatgaaatattgagttttgtattaaggccaaggatgaggaaaaaaaaagtaagtatatatggaaaaagaatggtattgaatgggagttttgatggagcatgttgacatcatgataatacctattatctttatattctgaatgtcagaacaaaattagagcaattttcccttatttccctacaatacgtctgtcttaataattctaagctttcctgatttcagtagtaatctgtattttgcaaaaggcagcatgtttataagatatcaagtaaactaagtttatggaacttgtaacagcatttttaacaacatttctccctagatagttcatggtagacatgaatttattcaaaactagtatgtagaaaaataccattaacaaaagctctgaaattatattagaggagctgaataatgttacttgagaaagaataaaatgttatttatgatttttggtatcttttacccactatatatggccatatctctgaaaaactttagtaatatgtactaatgcaaatatggtagtaaattatgtctacaggtgctgataccatagtagataaagtatgataactttattttaaaatatcatatttaaataattaatatacagtactgggaaagactattttatctattctctcactcttgaataaaaaaatccagaaaaaaataccttgttttggtaagattatatcaatttatttcccaaatgggtagagggttatttttttctgatcataaacgtatgtctcttcattataaaaatccactaaaagtgatagaagaaaaccaaaagaataaatgtaaacaatgatgccattttccaaaaatcaccttcgacatttttctggatattgatacagtctaaatctcttttcggaagactccctcctgtgtaggttccccaactactctgcaatcttatttcctcttgttctgttcttgtagaaaggagacccattgtcaccatgtcaaataacacaaaatggtgcacgtataagatcattgtctctgtccattatttgccagaggacctcaaactttttcaggtggtgggcaactggatgtcatgctgctccttgtacaacagaacacaattcattatttatatggttatttcattttaagaaaatttaactttcattagctggaaaaaaaaagaagtggtttttaagttgtttagaaatgtgaaattcaattttcatactgcaaaagagattcaactgcaaacacaggcacacatgtctggtgtaagaacgagttgtcatacaaacccaaattagctgcctccacgttgtctttgttaacaagtgtttgtttgctccttgttccatcattcagaaatgctctttagcaggaattgatggaacacagtcgcagtgacctcttcctgtctttaaaaatcgagatgacatttgcccatctgcagtgttaacatagttcctcaaagaccactgacagtggggtaggactgtattgcgcaagttctctcatttccctagaatataattggtccagggccagagattttagctcatttagagcagcaaggtgctcttttaaaattccctcacctattttgggcttcatttcccttatacggttatgccttttccagtctgatgaacattctccttgacagagcagacaagcaaaaggagctgcacactgctgctttctgtgtcgtctctatccctaaccttctcccttctgccccaatcagtgaaccttcgtctttctggttcttcttcctccaaatggaagtaaaaaggccctgaatgttgtctttaccattatcacgagcctcaattcattccaagctcagcttttcctcactgtttatacagttctatattgttcttctaatatttgccctcagttctctgtccctcgtttcttcccatgttcatactctattagaatctgagcacctttgaggttgtccatacagtggcacacatctttgttttatactcactgggatgatttgccattatattgtcaaaattttattctaaagagcttttacaggctttcttgagccattttctcttgaaattcaagatcgttgaatctctacgctttttccttcttaatctaataaacatacacccccacatacacacgtgtgttcctgaaagacagatgccacttgactcgtcttatagattgtctaaattgatcattgtgtgtggggataaaagggtgaattgtataatatccctgatggttcacgaagtctgttcctgtataacctgattagtcttctgaactcttttaaattctgtctgcaaatgactgaggtttggcaatcagcctatttcagttagttgttttcttgcataagaagggtccatatgtactgtgtgaagtaagagagagaaagtacttagatttgctggatgccctgattgttagcatggctaaggtattgtgtaagtaaggagagcagttaaaaatgatattgtttttatttcttaattgaggtaaaattttatataagatgaaacagacttatttgggagaggaggaagagtttgttcttacataacatttcaacctgtcatatttagttgagaacttcaatctgtcaagatactttgtataatattcagattctgccatctaatatattttccacgctttcttactgggtgtgacagtaacttatactgtggcaggtgtataagttagtaaagatattaaatgctcaatctgttaacttttgtgaagtggtcccactgataaagtgacacctcaataaaataaaaatttccattacctcagaaagctttttcatgctaccttccagtcaattcccagccccaataggcacctattcttctgatttatatcaccatagattagttttgtctttttaaaaatttgtataaatgaaatcatacaaaatgtactattttgatcagcatactacttttgagattcatccatgtaagtgtatcagctgttcattcctttattgatgattaatattctattgtatagatataccacaatttatttatctattctccttttgatggacattcaggtggttttcagtttttggctgttatgaataagatgctgtggacatttgtgtacaagccatttgtgagcatatgttttcatttagtttgagtaactctgtagaagtggaatggctgggtgaaatgtttaaatttatgagatattgtcaaacagcacctaaacagttttctaaagtggttgtgccattttgcaatgccaccagtgatgatggagagttccagttactctacatctttgtcaatatttggtcttgtcagtcattttaatttttgctatcttacagaatatgtaggtatattgttgtggttttaacttatattcctctgattactagcactattaagcatcttttcatggatttattggacattcatatagattatgtgtgttgaagattattacctttatgattattgggtgaaaatagtatcattttgaggtcattcatataacttgaagactgggaatgacagacattttcctgttttgtttcttttctttttactttatctgaagagtctactagaatgcagtgttgctgcctgagcagcagggcattagctttgtaaaagctctgttccttggcaaccccaccactaatatgaagtgcagaacatttgaattgtctttgaccagcttcagcatcagcactattttttttttttgctagacccctagtaggtatttaaaagtacagaaatagaatttaatcatgctttttaccaaatgtgctatgctcttagagattctttcaacgtgcataaaaattctgcagtttcaccacataccagtaaaagaaactcagtcactcatttagccatttagtaaaaagaacaaattaactgatgagcatagtggagacctcaaaggtaaagaagacaatgtccctgaaataaagacaatcataaattttcaatcaaaataatgaaatttaggctgggcatggtggctcatgcctatgatcctagcactttggaaggctaaggtgggaggattgtttgaggccaggagttcaagaccagcctcagcaaaaaagtgagaccctgtctccacaaaaaaattttaaaaattatctgggtgtggtggtatgcaccggtggtctcagctactcaagaggctgaggtggaggatcaccagagctcaggggttggagactacagtgagctatgattgtaccactgcactcaaacttgcatgacagaatgagtccttgtctctaataataacaaaatttaatttttatagactgtgaaaaaccattatgtagatacagttcaagtacagtatgattttataggatagataacttttgcttgaaaatgtattcccaatttataggatagataacttttgcttgaaaatgtattcacaatagagttagtatttggggcacacctttatccatttaacaaacatgttttgagcactgccaggtagcaacacgttactaggcactagagtgagaaaagattacagttcctgctctcatggatctcatggtctagtcaactggaatgaaaggattacataagtagaggtaaagacacacatgatggaggatggagaatagtcaaaggtctggagaatgaccaggacgtcactgtgagttgtctaattgcactgaagcatggatgaagaattggaaagtcattgtaagaagcctaaaaaggtatctctcagggatgctatgaggttctgaatgttatgtacgctatttgggcttcaacaggcaggcactgagtattcagtataaatttttgagcagggaatccaccagaagaactatgcatctggaggattaatctggaaagattgtgtagaatgttatgcagtgaaagagtctgagatgaaacagttaggagggtgtattaataacataggtgaagtgtaatgaataaccaggctggaggaaaagcaataacgatggaatcaaccgggcaagaagtataacaattaggatcagtaaaatagaatttggattggaggaatgaaaaaaaaagggacaaaacaaagttgaactgctggtatccatactggaaaatacagatgtcattcaaataaataatgtaatgaatataagaaaccagttttaggagtgaagtggatgttggcttgaaaatatttcctttgaggtttcagtcaaatgaaaaggtcctgaaatgctacgtggtagcctaagaaggaagcgttcctagagagaaaaaaattagaaaagatttacatttgataatttaatcttttccttcatacaagctaaattgataagaaagtaaaacctatagttttcaccactcttttacaaatatccctaaccttttagatattcacatgaataattgagaaaaatctaacagatgacttgcttatgtcatttgtctgctttatccttaggttcctctggcttatatattgttcaataaaatacagatcattgatattgtacaatgtactgataatggggagtgaatccatgcttgtgcattcttttttttttttttttttgatttgcagagggcgtgcccagtcaacaagagaggcacaattgtttttatcatcacctcttctcatctaattccatgaaggagagtagtattaccatacaacagataatgagttggaaaacaagaaacctaacctcagaacttaaggcttggggaaaaataaaagagtaatttgtgtttaatgcctgtataacttggcaagagggacatataaggcttagtgatgcccaacatgtgcttagatgtggattgttagttgatgtcttgggggttctgtaatctaagctaaatgctcaaaatcaattaattgatgttagacacagagatctgctttgatccctctttatcgtatttctaggccttcccattctcaagagcctgagaaacgacagctttccttaataacttgttatttgtggtaggagatgaaactttgataaaaacacaattatttttaaatgtctctttttcactctaggctgttgtatgtatttcaaaaagttacttttgaccctttccagaatgagaaagcaatcaagaagattataatatcttgcttagttttctgctcaatttatcaacaaatatttcttaagcaattattaagctgagcagtgctcagcgctgtacttggtgatataggaaatggggaaaagactgtctttaaggcctttataatagtaattacctcaacttgtctgtttcttttccttaccatttcgccaaattcattgatctatcttgttctcaaagcaatcgccatagttatattgtaacacagcattttctagggtgtccccattaagttgagagtgttgacaagaaaatacaagcttatttatcattgtaaaacttgagacacctagtagttaccctaaattaaatatttgttggagtcagtcacactaaagagaacacttactgcattgaacaatttacctacattagacagcatttaaagactatgccacagcaaaggcccatggaattcttgtgaacacagaatagaagtgtattaaggaacaagcttaattctgttctcttaaagcacaacactttctcaaaacatattttgaaatcacctttgaccattttttttaactaataggtgggtgggagttagggtaggaaaacacaagcagcttcatcaaaacgatattctattttcttcaaatttgtggggaatcatacggcctctcaattttctacattatgctaattatgatattaatctctctgccagcaaatgaaaataatacatattagatgtagcaaatgtcaataatgacaaaattagtcatcatgcagatactcagggattcccaaaatatgtttggattatgattgctagctttgagtttgcccagaatcgtttcaataaaaataagggactcaaacacatttggagcaaaactcacatcataaattttagacatagctctgccaataatgctctcagttatattttcagtcctaatatttcctctgagttccagaccagtatcttcaactgtctgattgatactctctccttcatttctgtctccaatgcattaagtcctgtgtatttactttccaaatgccacttggttccatgcacttctctccatttctgccactgactcctcctcaatccaagcgaccatctttcctcactttaactaccatgatatctcctgcttggtctccttacttctattcccgggctcctccaatccattcatcctccagcagagaatgatgactagcaccttccacagtgtctggctaataggaggtatccaatcaataattgacttacagagtgaaaatataggcatggcaaataccagtagagaactacagggttttagaaccaatgacattagatacttccatcaaatatttacagtgtataatcaagttgacttgcacattgtcttatttttgaaaaacaattttgttggctttttctatatgcacacatacatattgtatcaccctctacccgccaaatggcttttgaagaagtatttatgtggctccaaattgataatacctctagagagaagagaaattagaaattttaaaatgacctatgcttcctttcgaatatcacgtcctgagacagtgttttttgagttacgtgcaatatgttccacgatgaaacatttaatgtgttcagaggcatgctagtaatcatgtagaaagaattttatgcctgaagtcacatgttctataaccaggatcacttaataagaaaacaagtacagctgtggacaagatgcctttttatcagggaaaggccaatttgttttctttgcaaatctaagtaaatggagagaaaaacacagcccttaaatgttttctatttgtcctgaagttctcatgaatgagttagaaggcgagaaggattaaataaatccttgaacgtagagagagctaacatttattttagcaaactaaaacctattcgctttgcaaagttctgttctgtactttgtaacaacagttttctttaaaacaagagccaccaattcaaatgcctttacagaatgattgaatgctttcatgccccacctaaaggcattcaaatcattaatcaaacaaagttctaacgccaaaacatgtctgggaccagatttaaaatgtagccctcagtttcagagggcaaaaacttaacatatttatattttcctcactttaggtaacactgtattgaatctctgcttgaaattgaggagcacgtgattttttctttttggcccagggcagcatttcttggaagagaaagaaaaacaacccaagatacccttacaaaacatgtagtacttaaagctctttatgatgaattaattttggtatacacattaatagcagtgataataacaaatctatatatatatatataattgatatgaataagataaatacatcaaaaggaaatttcattacaatttgatattaggtaaatgtcccattaaaataaattgctactgtacataattttccttcagttcattggcaggatgtttgctttggaaaataaacagtctatttctagttttagaaggaattctcattattcttttatagcaaccattatcaggagcagatgggaaattgtaccaagagcatatctactattatacctcacaggaaaaagagagtattaaatgaaatctaacaaggcctgctcctgactctagttcctgtaacaaatgaacacacacatttgtatggtttcagcatttgtattagtaaggtacaataaatgtttactgaaattgaaaaaaaaaaagataacaggagaaagaagaggctaaaaaggtgcattttatttctgatcgttcattgtaaagactgctcctttttaaaataatcaaattttattttatatacagagggtacatgtacaggcttgtcacaggggaatagcgcatgatgctgaggtttggggtacagatctcatcacccaaacagtgagcatagtacctacctgatgagtagtttttcaaccaatgcgcaccctccctccttcccacatctactagtccgcggtatctgttgttcgcatatttacgtccatatatgctctatgtttagctcccacttataagtgagaacatatagtgtttgtttttcctgttcctgcgttaatttgcttatgattatggcctccaactgcatccgtgcttccgcaaaggacatgatttcattctttttatgactatgtagtatttcatggtgtatatgtaccacattttctttatccaatctaccattgtttcacaactagatggattccatgtctttgctattgtgaatagcacaagacaggacctttttatttgactgagttccttgcaaattactaataaaagatctggaggtccttagttaaaagttgaatctgtagtgccgttcaaatttagagatgtattttctgttcaagagaagaaagccctcattcggtcatgcttaatattcagctgtaaagtccaaaacatatgagaatgacacaaatggaaacattttataaatacctatacaaaggaggggcacttagttcccctaggcctcttaaaagtcctctagaaagagggtacttttatgctaactattaaagatgagtaacgaatttgtcctatacaacttaacagtatcgtcaaggaagtagaaagttactcagttttactgggcattggagctaagcttgaaagtgaggaggagaagcggcaggagacggagccgagaaggcagtggggagaagaggaggatggtcctttccatgctccctgttgtactaacatgtttggatattatcttatacttcatatatggactggattcttgtccttctcattctgagctctccttgaccttgattcttacctcctataactttcattctttctttactcaaaaaaaggccatttatttcagccatttttcactgttttcttatccttcctagttgcttttctatactatttttccactcttttttttttctatactattttgcccttctctccattttcctaactgctagatttccccaattttagccatctttcaattgttctgactatcctcaggtgctcccacaaggttatcagaccttccaccaagacggaatccctcagtctatggacaggctaagttgaatgggtcctggtgctgtgcttagcatatgccttgagtatttgtgcatttattttgcttctttacaaaaatccatcatccgatagaagttgaaagaaacttgctgaagcacattaaaatctctgaaaacagtattggctatattttctaataattagcatgactggttaacttgctttatttatcattgaaaaaagtatcagaaactgtatatcaaactcctgaattcttggcactgacgaagagacacaatgagaatgaccttaggataaaaaaacaagataaagcaccatatttgtaggaaattgcaccataaaagtctgtttcacaactctcccaaatttcattttattacatcttttctcttgaccaatcagtaaactcggttaatgatttacctgtctcaaaataattcatgaacaaaattacaagtaaatctcagtattggattcttgaaacatctccttgttcaatgaagtttcctttttcttccctctatttccctgtatttatcttttcttccagttgcattttatctcttctgtttttttatcttgctccctagtttgtgattttttgccaattttttatttcctacataattcatccaatctgtcattgtacaatttcttataactgcttcttagcttattccttttcttcatttgtcacattctatttttcatctattgtgttttcatgcagttttggaaagttttacaaatagacttttaaaaaaatgtacgtaatgttttcatagaaaaggtagtggtttctttttcttatatccttccctgtataaaaataaaaatgtagcagttctttctttgcctatgtttcctctttccttcccccaatttgaccagacttgaaggacttagatatgtaacagtgttattttctataatttaggaacagcttttgacttaaaaagcagaagagaagttgaaaataatatagtaattctacatgtccttcctgcttcccaactctctgcacatgtttgtaacctcccctttcttttttagtgtatctctttcatatacctttgtccccagaaattctgattcagtagacttagaatggaattctgggcttttatattttgaaaagctccccacgggagttagatatgcacttcttattaagaatgaatgcttaatattggaatcaaaacacaataagctttctaactatgatgaataatccaacagatttaattatgattttctttttgtccagaaccaagactagatgttaattgccagagaaatagataagaatgcctatgacagcagtacattaatatgatatcaaagcttggaaattttattggtaatgaataattcagtacttaaaatatttagaagctatagaattaaaattaattaatgttgttcactgtgtgaataaagttgattgagattttacatttaattttgtaaacccagtgttatcttttccagctcagaaaacaccacatacaagctactactttctgttttgatcccttatttttctttcttatgctttatcactgaaaactctccttgagcaggccatgcactgtaaatatttctcctggttgcaaaaccttctcatacaaatgcagtagactgtgtaatgagctcttctttcacaaaattaaaaaaacctgaaagccctgatttgcgattctatacaaatgagatttagatctaacaattttaaattattgcttcactcttagctgttcaattctatctcttatttgggaaaccgaaataataaaaccattgctgattccacaattaggttgtaaaagtcaccgtagccatcagccatgaagcaaaagtgccaagatcaaaactacaaagcaaagaggctgagataaaaatgctgcagcattagtttatagcattataagcagcaataagaattccttgattgcttaacaaagactcaaaaggcatttactccattaccttacaactcaaagaggtattcctggaccagcagtattggcatttttttgaagtttgtaggaaatgcagaattttggtgcctccacggacctaatgcagcagaacttgcagtttagtaagatctccaggagatttgtatgcgcattaaagtctaggaagcaccgctatggtatacatctgatgtgtgcccatgcattttttaaaagtatgaagtaatagttgtaagtattggacactcttgaaggaacaaataagagccatggtctttactctctaaatacctccctgacatctatgttttaggcaaaatttttttcccatttcagtagtcactgatgcttgcacgatgcagtttattccaaaacaatggtgattctcatgtaatagttcatgttgccttaataatttacgttgcctcaagttctctgcccaggccccaatatacaccgagggctgtactcctcccctaacgcctgctctcatacagtggcatagagcccagttttatgctcttggtcacatcatggagattgcacaccacaggctttaacttctgccgtactctcactgcctctaaccctccatatgcctaagttctacgattctttaaattccaaattgacccagaagtctcctccgctcatccttttcactgagatcatccctcttctggcctaccatttgttgatcaccttgctttttttttatcctactgtatgtagtataacaaattatcacttgcaactgtgtcttattttttcaactagattatgtactgcctaagacctagaaaattgtgcttatttatttgaatctctaggaggatcagtaatgggtattaatactaatgactccatggtgatgatgagcctgaacttcctcccttcctttctttctacctctctcctttcctcccttcttttcttcctccattccttcctctcttcctccctccgcttcttccccacttcccttattcatagattcatgcgttcactcagcaaatgcttactgaaaccttccatgcatcagacattgtactaaacaataggaaactatcatgaataagacacaatatctgacctcaaagaatttatgatataaaagtaatggcataaaccgtgattacttttgcaccaacctaatatatagacacagtttgttatgactggtgtctctattactaagcaatgactgtcacatgcaacgctgatctgaacaggtggtaaagagtgagatgtaagcaatggagcaaagccaactagttacaaggaaatatcacatgtttactagagcacatctcatgggcattcaagagagtatggccaggacagcttgtgaatagttcagtaactgtgcatagttttatattcattgtgaggcaccgtgtcaccggtttgctgatttacagagtattttaattgctaactgtatgctaccaaaatttccagtattcgaaaataattttgcttgaatgtagaaaaagaaaaaagccaagaaatgtatgtgaaacgagagtctaagggagctttacctcagtctcagaaaacatgcattccttccttcatttaggaagcatgtactggggtctactgtcagcttgctattgtgtcaaggagtaggagaatacaaaaatattagagaatatgaatcacatctattaggagagttttctacatacgcacattattctgtcagtgacataaggatttgagtcattcagatttaaatacggtaggtacctcaagttctcagatattatttcattttctaaggttcgtatttagttaatatgttattttaatggccttacaaattctagattatcttttttaaaaagttaaatagaacgtaattgccatttttatttaatggtaaaaagcatttttgtttttgtgtgtacttggttgtaatattctccttttcaattgagctatttttctgatactttactcttaaaatttcattcaggaaaaaagtaaacaatatttaagcttgacaatcataaaaatgctctggtgactatagattattttaaaatttattactgtagcttagggatatcttgatgggatgctcctgaaagcaattaattctcagttttttgtggcttctaatgcaaaatacattgacgcagacagaatttgaaatgaattttcttctaatatagcaattaattttatttaaatatctctagagtttttttttaatactgtgactaacctatgtttgttctttttcacctctcgtatccacgatcactaagaaacccaaatactttgttcatgtttaaattttacaacatttcatagactattaaacatggaacatccttgtggggacaagaaatcgaatttgctcttgaaaaggtttccaactaattgatttgtaggacattataacatcctctagctgacaagcttacaaaaataaaaactggagctaaccgagagggtgcttttttccctgacacataaaaggtgtctttctgtcttgtatcctttggatatgggcatgtcagtttcatagggaaattttcacatggagcttttgtatttctttctttgccagtacaactgcatgtggtagcacactgtttaatcttttctcaaataaaaagacatggggcttcatttttgttttgcctttttggtatcttacaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggtagggcgacagatctaataggaatgaaaacattttagcagactttttaagctttctttagaagaatatttcatgagagattataagcagggtgaaaggcactaacattaaagaacctatcaaccattaatcaacagcagtaaagaaattttttatttctttttttcatatactaaaatatatacttgtggctagttagtggttttctgctattttaaacttgaagtttgctttaaaaatcacccatgattgcttaaaggtgaatatcttcaatatattttaacttcaacaagctgaatctcagttgtttttcaagaagattttagaaagcaattataaatgattgttttgtaggaaagacagatctttgcttagttttaaaaatagctatgaatatgactatgaagctaaaaaaagtgatagtgtcacttacctctagtttcaccacatttgtgaatacattcttgaaggggaacttgagccaaagaggtacaagtttaatggggaaaacaaaacctcaaaaaggttactgtcaaattcaatcatcatttaaatttcccttggaatgtattgaaggcacagaaagccaaatgcgtgctgctgcagttggaaagcctagagagtttataaatgggattttgtattatgcttccagttgttgatgttaatgtgtcttgtttcgtaaaggaagacttggcctttatttaccaaatgagactattgttatgaacaatgaaaacttcgttcttttgccaagctcttgcatcccacccatcatccacataataggtggattttaatattcaggaagctagaacaactcattgatgaatatctttcgttaagatgtattaaaaagaagattttggaattatgtcagttgtctttgcccacctcctctttccctctttattcatgttacattattcagaaagtagatacaattcatattttgtacaaaataaacacattagttgacctaaacacacacacacacacacacacacacacacacacacacacacacacacacacacacaccccttgccaaagttaaagaattatagcctcatcaaaagatattttgaataattaagtcttggttttgaaaatcttcttgattatagatagataaaataaagaactaaactttgtagttaaactacttccttaggtaagtcatatacttttttcccagattgaaattcttctcttaatcatacaagtattttattatttagataactgatgtgcttatactatgaacaggtataaacctgtataatgtcatttctgaactaggctcaatctaatccaaattaagatggtaagaaatgagaaaattaaaaaaattgaataccatactataaatatatatatacggagagaattcataaagtggattaaatcgactggaagattatttttctataatatataaagtattgtttcctattttaaatgtcttactcatatagtatttgaatagagtgtattaacattccctctgataactctaattcacctgaattttcaaaatcttgttatctgttattgggctctaaaggcacattataatttataaacaaagatgtagcaatatgcctgtttcaccaaataagctctaaaattttagatctttctaattttataagaaagtggtatatgctgactctgttgtgaaatagtatacaaattttaagttaattacagctagggatttggctgtaattaggaaaaaaattttcccatttaaacatgttgacctacattaaatattgcacttcagtgctttaaaaagtcaagttcagcttccttgagttttttttttaagctgagcttttaaagttgtctatttcacgctacattttaaaaataaatgttaacatatttaaatttccactgagaccacttttgtggcatacttcctcaggatttttatatcacttaaattttatgaaatgtaaaaatgtaataaaatataagtactggttctaccaatatactcatagctatttctaagcatccagtagcaaatcaagtaaaaattaataaaataatattttatgaataatatgttaacctaacaattaattatagaagggctgtaatcacgaacctattgctaatcaatagtgtactctcagtgcaacgcaagcagatgttagaagggaatagaagttatttattgcaccggtgaaaaatatataagatgcctattcaacttaacaacagtagtcttcgtttgtaatggactttaagtacagcggttagaaatatttaacattttttagtccagggacatcaatgaaagaaagtgtataaattcaagctagatgtctatatggagccctgtagttgcaaaactttaagtcttctgaaattttaagatattagaaataggaaaaaaaatctcaaaagttcaaataatagtggacatccaagaaggttagtctatgttggaagcaaatgaagtgtgaaatgtagtcagttagcgatgcagtttaagatagacaattcactacagcttcaattatgtaacagaagaactggatacatctataggcttaagcatgataataatgagtttaatgatggcgtagccaccaaaactgtctttgtacacgaaggaggtgcaaataaaaacctatcatcggctgtaaggggaagtcataggttgatacaaagcaagcctgtgtacaagtctttaagcaagcgtccatgaatagcaaggggcgccatgctcttcactggagaagaaaattacctatttgtctttactaacctctaactgaaattaagcattccttttcattttgaaagtaggcaaaaaaatcacagtagtacaatcagtacctatgaagtcacagatatgtacacatctcattacagttataataaatatatcaaaatatcatttatgcttatcactacttcaaaactgcagtacttattatatgtgctacagggtcttattgttgggctttaaaacattattctgaggaatgtcaggcttcaacagattgccaaagaagtccaaggcataaaaaaatgatcctagccagctgtctgtttatctgcccagaatctcatcctaatttactatggtttcagtcattttaatgtgcagtcactatcttcatacactccttttcttctggagtattctaggagaagacataccagtcgaggggttctggggagccaggccttcaagcaatggattgctgacaacataatgaagaggattttacttagaataatgtcagttgataaaagtttgaatgggagacggaagcaaggcagtgggaagtggaattcctaaattgaggaacctctgaatcataatccttagcaataataattaagatttcaaaacattataattctttcttcttttagacaagtctgatattgcttatcccatatcacagataaggcaattattctactaatatgcattaaggaatagtggttttaatttaagtgttaccttaatgaaaataattttgaattttttccttccccaagtctttttgtgaaaaatttcaaacatatagaaaaattgaaacaattgcaaaacatatgcccatttacactgttttcctccccctaaattcttagagtcaacaattgttaacattttgccatatatgctttttttctctcgctttctctaccctctttctgtatctctcatatatagggcatcacacacacacacacacacacacacacacactttttaacatttttgcaaataagttataaataccattatattttacccctaaataattcagcatgtgtcgctttgaaatacagacatgccatatataaccatgcctgtttattatgctctcctccaaattaaatataatactgcattattgttaatatccattccatattcatatttccttaatagttcaaaaatgtcttttatattttgcaggggagttagtaccaatatcttatcatggctcatgcattacatttggttattattatttttcatccttcttagtctaaaatagcccttccacatttttttcaccgatattgaaatttgaaaatgtccaggacgctagcctcaaaaaatgtctcatctttcaggatttgttttattttttttcccctgatgggatgatttaacttgttctgtagtctctgaatttctagtaaactggaagttaggtctaaataagacttcaagagatgcatgtcaaacatgtttggcgagaatacttcatatgagatgctgtgtattttgtattacgtcacatcaggaggtgcatcatatgaagtagtctcactaaatgctgcaaagttttattacttgcttcaggtggtgactgacagatcttgcattataatgtcacattttttcttcgcaattaataaatcatctaatggctttagtatccattgatgatccttccctaactcagttattacactggggcttgcaaaatggaggttttcctaatctgacatgatcttaacatttaccagctggctttcttctgtttgaaaaaaaaaaaaaaaaaaggtttttcctctatatttatgtcaaaatggactcataaatttttatttattcaatatattattatgaattacagttattattcttgcccagagcttcctgctcaattgtcccaggctcaccttggactttgcctatcccagatttagaattacccatttttttcaaggaactctggttacttttagaggtgaatagtacgtagaaacgtacatctgggtagtagccccttctcaatggaatgtgtgcacctttctggcaagcagtcccaaaggagataatattttcagattaccttggaaatgattcttgacaaatctctttcagaatacatggaagttaaaagtaagtctagacatgttaaaaagcccttcttgtgtgagacttcatgtacggtcattaagttactactcctttaaacctctctacttctgaattcttaaaccaaaatgtactagtatataatctatgctggtttgccatgcaaattaatggtgtaaataagataatgggaggcattcgtaaatgtacttaaaggaagaaattattgtttaaagaccttagctcattgtttgcatgcaaatacacgctgttgattagaaatgagccttatctaattcattaaagtaggcctggttggtcctcttcttgaaagtctccattagcaattcatattgctctatgcgcttccttgtaagacaactgttgtctcttaagttttctttaactttggcttcttacaaattcagaccccacccccaaccaaatagctttcaaccaaatagcttttcagcatcttatttcctacaaattaaaagcgaatattttaatgactcaaatggctctttacagtgtgtgcaatatgttaaatgtacccagtatatccgtgtgaaccagtgctacaagcctgctcacacattcacattttgcccccaggatctgtcccgtccgcttgctctgtactcaaacttcctttttttctcattgccagtttagaccttgactctccatccagcccagagtttggaaactgagtacccacaggctgaatcctgaatgcatgcagtatttttgcatagccactgtttttaaataattgacaacttttaaaaattgagagacctcattttttaaaaaaatatggatttctgtcttcttttgaaaatttagatctggctactaggcactcattactatattttctcttggcaccatcacctacaactgagtaacagatgtttcattttcttgctactcaaagtgtggtctctggtccagagcacagacatcacctgggagttgctaagaaatgcagaatctaataaataacagtcagcatttttaataagatttccaagtttccaagtgattcatgggcacattaaagtttgagaagcattgcctggggtaagcaagctttgtcctcagtttgcagcacctgtcccactttgctcatttatattaattgcttttccatagatatttgattttatagtacctcatgcagacctttgtatgatgatgacggttagggtggtgatggaagtgatggtgataacacttaatattgccatgcactgttccaagtgttttacgtagctcaatacttataacaactctatgaaatagttgctattctccttttaattttacaggagggcaacgaaggcacagactgataaaactctttgcccaagattgcacagccagcaagtatttgaaccaggatgcagtcccgcagtctgcctccggagtccttactctagatcagattttgcattatttatcccagttttgtccatcaggattctctggtatacacttgcaatttcttcctaccaaccttctccttacctttgatggccacacgtagtagcaaaagaattgaacatagaatctgttctgacctatctttccaaccctgtttttcataatttccactatttctgtttatgtctgaagctttgaatgacctgaagttttctgttcttcagcttttgcaaaaaaaaaaaaacaaagaacaaaaaacaagacaaaaaaaaaaaaaaaccgcttcctttggttgaattctctttccccttattttttttcccaaaatcttacacatcccttaagactcatcttaactgctattacctcaatgaattgtgacctgctcttctcaaacataagcagtttattctcttaaggttttcttgcccctttttataacactcatgtaatattgtatgtatatatcatgtatcatacctatttacatatgcttttcccccagcaagattaaaagcttcatgagggcagaggactctcttattgttatctctataacccacagtacttaccagaaagcctgatatattgtagatggccagtaagtactttcttaatttaaatcgtaagaattttattcacattcagattaaactgaagatttaaatctttacacttgacattattatatagattaaaaatagatctaaagagccagaccaatttttctgtttttatcatgttatcacatttccatggatacgtttgcaattctagaaattgaccttgatcccttctagtcttaaaaaaatggaaggagtttggttaataatattttaggtattcttcagaatttagtacatttaagagacaagtaacttcaatttatttagctagttatggcaaaaagcagctctttgattcaaacattttgtacatttgtttatcctactctcactgtatctcaactaataccttttaagtgaattaagcaggaattagccctgaaactgaatgttttagcctcatcctacatatagccacaagatgttttagatgcaatccatatcaccaaagagctatttttagattgatcagagagaatcatacagatattattattcacaggtgtcaatggaaaagctggtctcttcccatctgttctctgatgactcttgaaaagctttcaagggcattcataattcttcatcaaaagactatgaaaaatcagcttcatagttaattgttttatgtcatattttattttttcaacttggctagttctagtgaaacagactagctggcaccaaatatgttgttgcattggctggtaatgatgataccactgtgtggagatatacaagtgaatgtactttatttgtggccttccatgaactttatgtgcctgggaaagtaggagttagggagagtttgttagggaacgtgatctctgggatgggtcttaaaggatgagaagaggcaaatgaagagtaaatggacatgccagagagaaaaagtgacaggagcaaaatcactgaagcaagaaaaaatggcctacattgaaggactatacacagttcagtataaaaaggctctgttaagcaagcaccattgacttaccctaaactcttcattttctacatataaactgcccaattcccactccaaacctattgatggatattagtaacctattgatgtttttgaaaggtgttcaagtatcctttctggtaccatgtaccttggctcccaccatttgagagtatgttctccaagaggcaacagtctgtggttcctgacctggctatgcaagttattcttattattaaaattgtcctatttaattaaatatcatgaaaactaatgaaatagaaatgaaaagataagagaattgtggtttctatgaatactaaattgaatgctttggaagacttgataaaggtgattagaaaaaaaaaaaaggccagatgcggtggctcacacctataatcccagcactttgggaggccgagatgggtggatcacctgaggtcaggatttcgagaccagcctggccaacatggcgaaaccacatcgctactaagaaaatacaaaacttagccagacgtgggcctgtagtcccagctacatgggagtctgaggtgggagagttgctcgaacccgggaggcggaggttgcagtgagacaagatcatgccattgcactccagcctgggtgacagagtgaggaaaaaaaaaaaaaaaaaaaaaaccacggtgctgttgaattagatgtaggtaagacaactgtttaagattgggtatgagggatagaatccccaaaaaatggaggtattttgcattgagattattttcagcatctccaaatctgactgtaattcaaagaaaccaaactaaaagtcacagattatgaaatgtagaagtgttttatgcaaaaagtaatatgcttaacttcaacctgtgggcttttactccaggaaaagtctcggaccccataccaaatgagaagtaaatgagtgaccacttgtatattctaagaaaaataaaatgtttgaagatgtgtaaacacatttatataatccctccaattttacaatatttttccaaaaaccgcctatccacttaccctaatcaagtttgataaggggacttccttttatatgtaggaaggctgaaaaatgacgccatgacaaatgaaattgtcaagatggaccaggtcatggaagatttgaaatctcaaagaattttttccagggtagaatataaggatgttgggacgtttttatatgctttagatttgcatcctcatatgtccctttgacagttgagctcagagtgaaaaaaagagagtgaaactagtggcagggtgactcaagttagagacaatgagtaagcagaatagaactttaaaaacctgacagattcaagaaatacttgatgaaagtggaacaatttagtcgttaagtagatgggatgatgaggggaatgaagggacaattctaggatgatcccttttccaggttttttgcttgggggaactggctgcatggaaggctgttagtcaggataggaaatacaaaggagagtaactgaatggaaagaggaaagcaaatcagacatacagagctcaacttgggatataatagtcttaaggagctcttggaacattgaaaataaggtgatcagaaaacacgcatttgaataggtaagtctgaacatcaggaggaagacaagggctgaagacactgagccattttgctgtcaatgtagagatggtggcaatctccattgaactaactgcttctcaataaggtacctttctcaagtcattaatttgctaaccagtaaacaaaccagaattcccagagtacacattaaccattaagcactgctgtggaaaaggagttcaggtgtcaggaagccaacgtggcagatgagcactagtggtgacaaatgaaccaaagtgatatgggtgatctttatggggccacagagtaccactgtaaactatcacaaatcagaagggttgacaaacaaaatattggggataaatcagggaaaacctaccacaacatacaggaaaataagttcaaagatttcatcctacagattgcagataagaaatgagccctttttatttggggcaccctagggaaagagtagatgcccatatgtatatttaaagtatgaatacagcatttatttgaatatactgcaaatggtcaatacaagggtagctacagagcccataacatgaaaaggaaacacaaagaaatacatgccccagtcagactccttacttgggttgctgtaaattctctctccctttaaggttattgcatttaaagtctatctgttgattggacccaacagcagctgcaccaagactgtaccatttttaaaaaaaaaaaaaaaaaaaaaaaacaggccaaatggcattctgcatttattttccttgttgctgaagaaacttgaattgtctaccctcaaagcctgtcctttgagacacattttataattagaaacacttatttacaaagttctttttatgttagaatcacaaatcataacactccaaaaaaggaatacactatcctcaggtgagtgtcctacctttgtttacaaaagaaaacccaaagtcctaagagaaaaatgtgttgatcattttattgattccttaccttggtttaatatagttaatggatgtcttagatatgtataataagtctattatcatgttccctttaaaattctcttttgttttactaattatatgttgtcatagtttgaccattaatataagtctaaatttattataatgtgattttttctacaaaggttaatttgaattaaaatattttattttatctctctctactatgataaatgtttttaaaaatcgtttgtaaaatgaaagtactatatttgtgtaagctgccaatctaacaatttatcatttaccattatgatggtgaatgtataacaatccttatattcagcagaaagccttatctctcatttcagaggaatcttgccccggttaattattctgtctcttgaatgcacacaaacacaagcatatctttaccctttttctgctgcctcactatccctgatcaggtgaatgtttttagctcctagattacaatataaatatattcagacattcctttccaaatgcattcattccactgtacttgtcagagttcatagctgtgaataacagaacccagtttttgttgatagaagcggaaacggactttaggagaaagatacagacctgttcccattcctaaacaaagggatagaaaaccagctcaaaatgggcagaactcaaaaaagaggctcagctccaagaactatagtccaaatcataccctagattggatctcgaactcttggactcaagcgatccactcatcttagcctcccacagtgctgggattacaggcatgtgccacgacgtctggcccccatacactagatgtaaacgttgccatgcaccactctaccactgcagacactgggtgaagaatgtcattgctactggaaagaattctagatagtgccttataattctgtcactcattccagattcaaaaactgaacttcccccatcagattccatttgtatttggggattttgttcgacataatcagggcattcagattctgggcaaccaaagttaacaaatgtctcttacttcccctttcttgttattattcccatttgaatcttcttcatagttagtcactgttacttaaacacacattctctattatcacatttccctctcctctcttttgctgtttgcttttgatccaaaccactgctcagaaaccattattgccaataacaacaatgatttcttgtagttaaatccactggacatatcttagtcctattatccgtaggccatgtgccattaactgaacactttccgtattagcacttggtcctatcttatcttccaagtcactaatcttatctgaatttattcttacctctctatgtaattccttactatattgatgacactccttgctttacctgccccttacatcctgatgtttctctaggacatgttctgaaccctcccttcttctcattctatacggtttccctgattgttatccatagcaacaaatgtagctttcactgtatcaattagaataatatctagggagattaaaaaagaattatagtaactgaaacaaagtagaaatatattcatcttcttgtagaaggaatctgccagtaggtagtccgaggttggtatcattgctctatgatgttgaagatccagatcccttctgtctcacagatctgccatcctttggtgaggtccttacactcatggatcaagatgactatcagctctctatctatcacaactgcttttcaaaggctgcaaggtgtaggaagtggacaaaaaagggatacctctacccttttaaagggacttcatggaagatctacacaacactttagcttgtatgtcattggccagaatttattctcatgacaatgccaaactgcaatgggcattcaaaatgtagtggaatggatcatgggctaagcagctaagcagtctctaccaaagtcaccgatttcattttatggcctaagtctaatatttggcccaatatatagtttcagattagacctacatatgtagcttcaaatggaccatttcctcttctatgtctcaaagccatctcaaagtcagtatatccaaaactcaacatgttatattcctctcccaaaatctactgtgggtgatatcactatctattcatgtacccaaactataaatttggaagttacaagagctagtattaatgacactaagttttgtgcatttactctatgaacaggactttgataagagttttacaaatgtttcccacttaattgtcgcaatatctcagttatagagattttatacgtccatcatctcacctgactcttcgagatcataagcaaagcatggcagcattcttatgtccattttacaaattaccacattaagcacaagaaaaaacaagatatatgtccaaggctaaccaaagttatagaaggatcgagaactaaaagtcagtgatttagacccagatctgtgccttttcccttattgttacatatgaccatatctagctatgtgaacaaagcagctaatagtgacgacagggtagaacaaataagaaagtgaatattccccactacatttatgattatttgccagtttaacagcttcaagcctgtgtcttctcagatatgtgcttcctcttatgtctaaggaaaagtactatatttgatatgcttttatgaactttcttttttgagatggggttctggctctgtcactcaggctggaatgcagtggcatgatcacagttcactgcagccttgatctcccaggttcaagcgatcctccaacctcagcctcctgagtagctgggaccacagacacgggctactacacccagctatttcttttttttttttttttttttggtagaggcaggatttcactgtgttgcccacctggtctcaaactcctgaggtcaagtgatccacccacctcagcctcccaaagtgcggggattacaggcatgagccaatgtgattggcctgaattttttaaatttaattttattgaggtaaaatatacctctatataaataaaagtaaatatacctttaccatttttaagtatacagttcagtggtaataagtaaatttatgttatttttcccctttgtcccctctccctactcctatttctgatctctggtaaccaccaaggtagtgtctactttcatgagatccatgtttttagctcccacatgtgagtgacaacacataatatttgtctttctgtgcctggtttaccttacttaaaataattacctccagttctatccacgttgctgcaaatgacaggatttcaccctttgtatggctgaataatatcccatggtgcatatatatatatcacattttctttatccattcatcctataaattttaaatggtgtggaatttggagaatacttaaggaaaaatgacgattgtgtaaaaggaaagtatctacaaaagcaaggtttatctaccccataaagataacaagagaatctgtgaatgtggatacggtttctggagtgtttcagaggttgaaagattgtgaagaactggatgggtataaaaaaaagtgaggaggagaagaaatgaaagttctggaatgttctgtaaattgtagatgagttccctatattaattttaaaatgtaaattgagattataattattttttgatgatctatttttgctgggctgattctctgttggtgtaactctttaacgaatatgggtcacgtgggaccctggattttattagaattacatgtgcgaatcaaattctaactttatgagccaatataatgattgtttttttaatgattagagtctatccatgacaaaaacagcttgtttctcctactgacttatttggtgttttcttgctaattagcctttatactaggcagtagtaaatcagagtacttggacttcaggttggccattacataaacctggcaactaaatgctgggtaataatcacctatcttcccacctgtgtttattacctttggaagtatgtaacatggtatctttgcgtttatatttttaatttgttcttttttctcttgcaccagctacttaaattatctgagcttccttttactaatccaaaaataaagataatagtacatatttatagagatgttgtaagagtaagaggtaatgtaaataaattggctagctctatgcccagcacatgagtaggtgcttagaagttagtgtctgggtacatgacttctggggatgataaagtgagtagctcgataaatctccccaagaatcagtaaaatgggacacactggagaaaacatcttatgaccctggatatcaaccaacggcatatgctaaattaaaaagtgattatttataaaaagtactaaactttgtatatgaacaatatgaatttgtggtgtatttgcctgtattgcccccagtccccactcccagcttggtcaagcataatagttctatcaaggtagaacaagccatggaaataagcagcttcatcaccacagggactgattttatttgaagcagaagtttaaaactccatgtccagaagcattgtcagtaacggtggagacctaggcggcaaacaaaaaggcagaatagcaactcagctggcctaaagttgcagtcttgattggaacaagtaactgactggcagactggccagaaatttaatttaaccagcatatctgcaaaatgaggcagccgtaataggcctcagtaaggactccttgtgtctccttcatgaaaacttaaaatgtgcctgcatgttgaatataccctttaacacatataaagaacctttagcaaaacttggaagtcttactggcttgaggtatttaagatcaactgctggccaactattgactaatgcaaattaagctatgcttacctctaggaaactaggcatacagtttgtttctgttgtttgacagagaaagaatatcaacagccacacactgtggggaaacagattccacagatttcatctaggcaagttattaaaacttcaatttaaaaaacgctgggcataagaaggaacatcagaatttggggctcctttaatatgttatttaaaatgtcaaattttcaagaaaaatttacgatacgttcaactgtgacccattctcatggggaaaagcagtcaacaaaagttgtctctgaattggcccaggtattggcagatagagacttaaaggctcctactataaataccttcaaacaactgaagaaaagcatgtttaaataattaaatgaaagtatggtaacaataactacaaatagagaatctcaactaaaagatacacactatataaaagaaccaaatgaaaattctagaattggaaagtagaataaccaaaatttaaaaaaatcactaatggggctcaagagcagatagtaagacagaaaaaaaaaaaaatcagtaaatttgaaaatagataaataaaaattatccaatctgaatgtcagaggtaaaacagtataaaaaacgaacatgagtcatagctttgtgtcaaaacattgagcatatcaatgtagatgttacaagagttccagaaaaaaagagaatgttgttaaagaggcagaaaaattatttgaagaaataatggccaaacacttcacaaatacggttaagctcaacaaaccccaaatagaataaacacgaagagatcaataccctaaaacataagagtcaaactattgaaatagtttcatttgaaattattgaaagacaaatgggaaagtctttaaaacaaccagaaaaaaatgactcctcatgtacagggatcacatgattgatagttaatttctcatcataaacaatagaggccagaggtattgaaatgacatattcagagttctcagagaacacaaaattgccaaccaagaattccgcataaaacaaaactatccttcaaaaatataggtaaaataaatatattaccaagttgagaatgagaatatttcttgctagctgacctgacttacaagaaaaaactaaataaagtcattcaggctgaaaagaagtgatattcagtaactcgaacccaaatgaagagataaagaatcacagaactgataaatatgtagatacatataaaagactgtacaaatatagatatatgtttttcttcttttaacttctttaaaagacctaagattgcataaaaattataacattgtgttattgtgtttataagcaggaggagcaaaaatggagcttagcagagaaaaatatctaaattttactgtgttaaattagtttgaacttaagtaaattatgatcaattaagatgcatatgtaatctttagagcaagcactaagaaaataaatagttaaaaacaaaatttaaaattacacactaaaaataactaacaagacagtgcagtaaaggagaaacaggaacaaaaaagacatgaataagatgtgaaaaaatacaatatggcacatgtaattgcaactaaaagttgagaattcccattaaaaaaatctgaaatttgaaatgctctaaaatgtgaaactttctgaaggttgatataataccacaagtggaaaatttcacacctgacctgtaatgagtcacagtcaaaacacagccaaaactttgtttcatgcaaaaaattatttaagatactttataaaattacctccaggttatatgtataagatatctattaagatatatatatatacatatatatatatatacatatatatatatatacacatatatatatatatatatgtatatatatagtatgtgtgtttaaacttaggtcctatctccaagatattaggtatatgcaaatattacaaaatctaaagaaatccaaaatccaaaacacttccaatcccaagcattttggatatgggatactcaacctacatatcaatagttatagtaaatgggagtgaactaagcattccaattataggcagagatttcagacaggattatttaaaatatccaaccatagtttgtttaaaagagaaatgtattagagccaaaaccatataatttcaaagaaaaaagaggtactatgcaaattgtttacatataaaaaatgaagtgacaatactaatgtcagacaaaatagactttatgacaaaatatgtaacaagagaaaaagacatttttaattatataaggggtcaattaagcagaaaatataacaattataaacgtatataattaataggaaagtcccaaattctatgatgcagaaattgacagaattcaaaggagaactagacaattcaacaattattattggagacttcaaaccctactctcaatagctggcaggccaattagacagaaaaatagcaacaatatagaagaattcaccaacactatcaaccagcttgacctaactaacatttataggagacgccaccaaatgaaagcagaatacatattattttaaagtgcacatgaaattttctctgggatagattctatgctaggtcaaaaaacaaatctcaatacactcaacaggcttgaattcataaaaattatgttctcttaatatgtcagaattaaattggaattcaacagaaggaaatttggaagatatcaaaatattttgaaattcaacaacttctaaatccattggttaaaaactaaatcacataggaaattataaaatattttgaactgaataaaaataaaagcacaacatgtcaagatttataggatgtaactaaagcagtgcttacagggaaacttctagttttaaatacctattttagaaaagaataaaattcttaaatcattaactcaagctttcgccataagaaactagaaaaagaagaacacagtaagctcgaaggaagcataaggaaggaaataacgggggttagagcagaagtcaataaaatagaagaagaagaaagaaaaatcaatgaaaccatacattaatctttgaaaatattttttacatggagaagctttagctagactgaccaaaaaaaaaagaattaccaaaatcataaaggaaaaaggggtaattactaccaaccctacagaaattagaaagactagaatgtaataacatgaacaacattgtcaacaatttctgcaaaacatattaaatgaaaaaattcttagaaagacataaattaacaaaactgattcaagaaaaaaatagacatatgaatagacctaacacaaacacagaaactgaattagtaatttaaaattttccaacaaaaaaacccaggtccaggagaaagataggaatccgaggcatccacagtatagaagaagaaatgaaactctctttattcacagacaatacaatcctgtatgtagaaaaatctgatatccacaaaataactgctagatctgataagttcatgaagcttgcaagataatcaatatacaagaataaattacattcctgtgtactagcaataaaaaattgaaaatgatactaagaaaataatttcattctttgtagcataaaatagattaaatggtcataaatttgaaaatataagtactaaacctgtactctgaaaactgtaatacattgctgagagaaattaaaaatctaaataaatgggaccatattccatgttcatgaattggaagactcaatactgataaggtagtgattctccccaacttgttctatagatttaatgcaatctccatcgacatcttagcagatgttggcacaaattgaaaaattgcacaatcttggcacaaattgaaaaattgatcccacaatttatatatagcaattcaaatgtaccaaatagccaaaacaattgtgaaaaagaagaaaaaagttagaggactttgaaatcaggacattacctgatttcaaatcttgatgtaaatctgcaatgatgaagacagtgtggtactgtcataaggacaggcttatagatcacctgtaggtttaggaaacaaacctattcatatttttttcttaaatctactaactgcactcctaatgttgacaatggaagagactcgatagtccagcaataaactcttatatttatggtcaatcaatatatgacaaaggtgacaagataatccaatagaagaaaagcttattattgggtagcttattgttagtgtacagaaacagagctgattgttaatacaactcaacaggaaaaaggcaaataacttgatttttaaaatatttaaatatatatttctccaaagaagacatagaaatggccaacaggtatgtgaaaaggtgctcagcatcactagtcatcagggaaatgcaaatcaaaacctctgtgagatgaacactatcatctcacccctgttaggatggctactataaaaacaaaccaaaaacaagagataagaaatgttgttgaggatgtgaggaaatcggaacgctagtacaccataggtggtaatggaaaaatgatgcagctgctatagaacacagtagaaaggttcttgaaaaagttaaaaatagaactaccatatgatccagcaacctcactcctgggtatatatcccaaagaattaaaaccagaatctcaaaaagatatctgcactctcatcttctctgaagcattattcacagtagccaagatatcaatacagcatagctgtgcatggaagaatgcatggataaagaaaatgtggtgtattcatacagggaatattatttggccttaaaagggaaggacgtcctgccatatttgacaatatgtatgaacctggaaggcattatgctaagtgaaataagccagtcaccaaagggcaaatactgaatgattccatttatatgaggtgtctgagacagtcaaactcgtagaaccagagagtagaatgatagtaaccaggggctgggcgaagggggaactgggagttgctgttcaatgagtataaagtttcagttatataatgtaaataagttctaaagatctgctgtacaacatagtgcctgtactgtgcacttaaattattattaagaggatatgtcttaagtgttcctaccataagaagaagaagaagaaggagaaggagaaagtgaagaagaagaaagaaaaaatgaagggggcatgagcaaacttttggagttgatgcatatacttggttaccttgattatggggatggtttcatggttgtatgcttatatcccaattcatcacattgtatacagatgctcctcaccttaggatgggattgtgtcctgataaacccatcataaattgaaaatgttatgagtcaaaagtacattttcaattaatgatattttcaacttacagtgagtatatccagatataaccccatcctcagtccaggattatactaaatgtgtatcgcttttgcaccatggtgaacttcaaaattgtaagtcaaaccatcgtagtcagtcggggaagatctgtttgttaattatggacccatcgtgtacaccttaaatacttaataaagctgttaaatgaaaattaaaagttgactgggcacatggctcatgcctgtcatctcagtgctttgggaggccaaggcaagaggattgcttgaggccaggagttcaagaccagcttgggcacatagcaacattccatctctacataaaattaaaaatgtagccgactgtggtgatgcaagcctgtagtcctagatgctcgggaggctgagttgggagaatttcttgagcccaggagttggaggttacagtgagctataatcatgctaccacaccccaggagaccctgtctcaaaataaataaatagaagctttaaaaaatattggtatctcagtgttcctcattatccactgtatttaaggtttagctacttgtgcttgatgcttgacaaggtaatcttacttttctccctgatattggtatgatgcaaatttactatatatatgacacaaatttatatatgcaatattttctcgttaatggccttttattttactctcattttcattatgctttgccttttaagtcatatagcaaataaattatgtggcattttcttagcaactattaattcaggagaatgggaacagaattctctcatagattcagctggaaggtaatgatggtcagctcccagtggagaaaaaaaaaaaaactcccttcagttttcgtaaacatacagagaaattttctcctaagtgctatgtcagtctgctgtatgtcctattgatctgagaaccagaaaacacatattttagtttacactgccttgactctattgtacatggctaggtctgtttaaaaaagaaatccttgaagataccctttggattctagtattttaaaacggatgcttagctaagtgaagtggtctacttcaaggatcaaaaccaatcttgagtaatctgttaggtagactccctaagttcatctgtaccttgtaccaaatttttaatgaatttagtaattgacatggatgtaaaataaataatacactaataaagttcatgcagaatcaaattttaatgcccagaggtaatgtagaagatattacctgtccatttctctggacttagctcctgcaactctccatttttctctctaaactttagccacactgaattcctagtttcaattcctctgactcgctaagtatttcttctaccttgataaaagctaattcctttgtcttgtaccatctgtattccggctgatattgacatagttttcagggctcaatttcaatgttacttactcagagggactcactgttacaaccaccacagccttttcaatctaagtaagatccactgctcttcttagaaacaggttatattccaaatgactgtaagtgcttttgttcttagaacatatgtctccattcaaaagaccgatagatattcagttaagccctttgagaaaattataaatgttgaggaccttgattattattgttattattgcttcttttctatgttttcccaggactctcaacaaatttgctttgcttttgtactcatggcacataatgagattaataatgtttagaaaacatttcaaaaatacacacagaggagacacatcttagtctaaagttagacatgataccaaaaactataataactatagctgaccagtgaccccatttattcatggaaagtaaaatttgatgcatatttgcctttaggagcaacatacctatgaaagttctgaaagtgaaagtttgtaaaaaaggagtactctcctaacaatcttaatttttttctatatatatgtatggtttgcattaaactcttttgtatgattagtggtttaatgttgatgtcacccatgacaccataagctacgtgtatggactggctctgttttgttcactcctgaatatccagcaaaaatagtatagtgcctggcccttggtagatgtgtaataaatgtttggtgaatgcatagctacacttcaatgcttatcgcattttaatcccagctactcggaggctgaggcaggagaatcgtttgaacccaggaggtggaggttgctgtgagccaagatcgcgccactgcaccccagcctgggtgacagagcgagactccatctcaaaaaataaaaacaataaaaaaaaggagacccattcatgtatctgtatcactgactagcctgtcaacattttgttaactacctcatcaagtagcaaaatcagtacctggtatgtggtagatgctcaaatatttgttgataaaatacagtaagttaatgacaggcgagcttgcctcagtgaaatataatctgtaagtgagcagtgtgtatatcatttgaaggtgccctacttagcctagcatatcacagagattcccagtaaatatttaggcagttcattaactctaaaagttgaccctcatagtcattggcctacattattcacctccctctgtctctaataaattcattggcaaatttctgaactccaactggaatgtttgtggtggatttcttcatacctaatggattatttcaattttcattttacattgtattatttacttgtctgaggtctttataatgacaaactcggcatgcatgataagctgtcattacttatgccagttgacaaggacatattatttttctacaaaaaaaattatcttggccaggcgcggtgcctcacgcctgtaatcccagcactctgggaggccgaggcgggcggatcacgaggtcaagagatcgagaccatcctggtgaacatggtgaaaccctgtctctgttaaaaatacaaaaaaaaaaaaaaaaaagcagaacaaaacaaaacaaacaaacaggagtggtggcgggcgcctgtagtcccagctactcgggaggctgaagcagaagaattgctcgaacccgggaggcagaggttgcagtgagccgagatcgcaccactgcactccagccgggcgacagagtgagactccgtctcaaaaaaaaaaaaaaaagtggtaattgttcaaaatatttacttattaattcattttaaaattgcatgttgaaataaaaaataaatgtttagtttttaaactatctcttctacaacagaaacaatatagtgagaagagtgatcttgttttacatttttgcaaatctctttaaaagttagcttaagagaaggcagctggttcttatatctgtttctgcattgaatgtgctgtcatatctcgcatcatgtagcctctgaaaaactcataatagaatgagagaggaaaaagtcaaataacatcttagtattattacgaaaataatttggacctcacagaaccactgcatgggtctcagggactcccaggggtccccagaccacatttaaggaaatactgtttcagggaatataactatttttgtacctcctgtggctatattcttttaaagaatagtaacctctgtttctgaggaacttagctgcaattatgtgcagagtttaaataagtgaaacggaaataccctttgcctttctgctcgagtatgaaagtgatgatcaaaatgttcccttttctctctctctctctctctctctctctctctctctctctctctctctctcactctctggggaacttcgggtttccgtctctatataatgtattcatattccactggaaacatacatagtttgagaaaacagatgacattttttctgggggtggaaagaattactaccacgaggaattcaaaatacagacacagtaataaaaatcaccataaagcccagaggggaaaaaaattgagtaacaaaataggaggtgaaattataaaactgagtaacaaaaaagaggtgaaattataaaataaatgataaagttggttgtgggttaggaagaaagagaaatataaagaaactggcataatgtaaaagccaagacaagaaaagtgaggcagaggcataggtcttttgactattttccatgtttgattctaaggtaagtagatatagtttctcatagttggaaatgttcgtgaatttaaacagaattaatgtttataatcagatgcaatgtctagtttttctatttgtcctgtgaaataataattgtgtaaagtgctcatgattgtttcaaggggtgaggagtagttctaattatcatagatattttcatgacttcgcataccactggtttatagagattatacagattttcttatatcagaactctcgtatctttaattccctagtagatgtctaagaaggagatttatcacatagcagatggtggtaaacttgagtaaagtgccagatactaaatgcctttggctttgtgggccattcaatctttgctgcaactactcaactctgctattgtagcatgaaagtaaccatagacaatatgtaaatgaatgagtgtagctctgttccagtaaaactttatttacaaaaacaggtggtgagcacaacttggttcatgagccatagtttacaaacacttgctgtatagctttccctggttgaatttcgttaattttatacagaacctgcctcccatacacacacactttgttcttcatggaaaatctccccagactactatgaaataatgttattacttggagatatacaattaagatgatgtcattaggagattattaatataggaactaagcaaatactatatgctaagtactgaggatagggtgcgatcacaatagatagaaaatctgcaatagtttgatgaacatgggaaattacagtatttcctgtgatggaaacattatgaggggctgtgggactacataacaggacctgtgacctatacctgggttggggatgtctaattaatcaaggaaagctttgtagaggaagtgatgtctaacctgagattggaaaggtcaacctggagctacctagatgaagatgtatggaaggacatcccaggcagagggaacattgtatgatgaatcctgatatggatatagtgctggattttaaggaagagtaagttgttccatgaactatacagtgcaaagaaagatgaagaaatagaagtagagaccagatcacaaagggctttttgaccatgttagagaagttatattttatcccattggcactaggatgttgttgagtatatgaggacatgatcagcaacatattttagaaagatctcttattctgaagtgtaaagagtggataagaaggagacaaggtaggaggcacgagctaattagaaagcagtctcagagaggctgttagaaatcagaacagaatggctattattaaaaagtcaaaaaacaacagatgatggtgaggcttcagagaaaagggaatgcttatacactgtttatgggaatgtaaatgagtttaggcactgtggagagcagtttgaaaatttctcaaagaacttaaaagagagctgccattcaacccagcaatctcattacttggtatatatttaaaagaacacgaatctttctaccaaagagacacatgtactcacatgttcgtcgcagcactatacagtaacaaagacatggaatcaacctaggtgcccaccagtggtggattgaatgaaataaacgtggtatacatgcaccatggaatactacacagtcataaaaagcatacagtcacgccttttgtaggaacatggatgcagctggaggtcattatcctaagtgaattaatgcaggaacagaaaaccgaagatagttagaagctaaacattgggtactcattataaaggtgaaaacaatagacattggggactactagaagggggaggaaggagaggggcaagggttgaaaaactacctatcgggtactatgctcactacctgtgtgtggtgggatcatttttaccctaaaccttggcatcacacaacatactcaggtaacaaacctgtacgtatactacctggatcaaaaataaaagttgaaatcagaatgagaaggagcgaaggagacagcgacaggaggatggagagaagtgggcagattcaagagagatttctcaagtggacttatgaggacatgcttattgatacgctctgggagtgagggagagagaagaatcaaggatgacttctacactttcagcttaaaaaaccgggagctggtggagtcatccattgaacttgacagaggagcacgtttaggcaggaagatgatggtgtttgaatgtctgcgaagggaaaaactgaactgggattcaaatcagaaaaaacggtttgaagtcataccctcttaattgcattttctatcggatggtaatggctttgtgacaggctttactgataggtgatgtaactctgcctctgacagatgaagatccaaagcatcctcagattttcccgaagcctgtttcagcaactgtgtagacagcacacacaaaaatctggggggaagtcctagggctcagttagttgattggatctattaaagtagcattggagaacacagttcagtctgagatttcccaaacatattgctctataatttatttttacccagaaactgaattcgatgtgggatagggattataaaagccttcagattccagatagaatctctgaatagaaggcttttgggccacatctagtaatctcctttcctcactccatttctgaacttcttgttcacttcttcgctgtttttaggacgttcttactacactcctgcctcaaggcctttgtacttgttttctctgcttagggcgttctttcccgcaatatttgcatggcctcctccctcgcttctttatttctatattacctatctttattaaagctgctataaaaaaaaaaaagcccacacctcagtggcttaacataatagaaactttccgttcatgcaaactttacaaaaattttctggtcaacaagtagatttcctccaaatggtggatcaggggggcccagggcacttcgcttttgtggctctgatgtctttaacatacggatttcaaaatcactgtgctcttgtacataagaatgaaaaagaacaaggaatattacatatgtggtggtggttattggaggtggggttatgagccaggcttcatattcatgagcatcacttttgctcacactccattggctcgaactcagtcatgtagccaaactaatggcaagggagactgggaaatgacagctagctgcacaattaagagaaatgagtagacttgtctaatgagcagctagccagtccctaccacgaggactttgctcaaatgtctccttctccatggaaccttctatgatcaccctttataaaatcacaactgctccccatcttcccctcaatatttccatcccttttccatgcttcatttttttcctctgtaacacttactgtatcacaatctatagattttatttctttatcttgtttactgtctgcctccccttcctcccaatcggatgtaaggtccatgaggcagggattgctgccgatattcacggccatatcaatggacactagtagaccctcaataaatggctgttgcattgtgattacatatatgcttcacctagaagtagtctcatctggtggcacatttactcatagattgacattaattctctattgttttttccccagcaaaatttgtcaaggtagtttgtcagtagggagaaataaagttgtcaggtggctcatcaaaagttcaattttgagtactcctcctgtgtactcataatgttttataaatacttttatctatgtaagcacgtgggcttagacacaattctaggattaaaacagaaagctctgtatccatattttcccttttttgtacctccttttatgttctctaccattttttttgagtgctgttagtgaagcactaggctaaatcttgggtttctgcaaaaaaaactttaatcctcacaacactctaaaatgtttattgttctaattttaagacgaggaaactgagggctaaagagattaaggaactcgcccgtgttcacgtactcagctgataactggcagcatttagatttggacttactttccatacagatattcgcattgctaaccttcaggtttttccctcatcgttttccacatctactcaaaagttgctaatcatttccttaatagtgaggcataaatgactgagaaatcttgatatattatccccctcaggagcacttcattccgacaagacacaaactttagggaaaatgaacaaatgtctacttgtacaactcaagcaccaaccaggtatggtagacatgttggcttaaaaataaagttgatgcttgggttctgattctgataatgacctacggagggtatggcctgaggaggttactaggtgtgtgtagaaatcaatgttttgttttggttttccctcgggaagggtcaacttatacttgaatccttctgaagtttctcaaattacaagatggtcatttattttacttcaatcaaaacaacaaagtactgtccgggaaagatgtattgccttgacttattctcaatttatgcttattttggaggcttgtagaagtaaacctgatagaggagggcaaaaacacacacacacagacacacacacactgggagaaaataaatttaacacagtttagggattgactttggttgtatgacatcacaattgcaagagttggatgccattgtaaacaagctatggaaagaatactgttaaaagtaactcattaagtggttacatggtgtagctcatggacatatggcacagaaaaaagataaagctgtctttacataacataaaactgtattctgttatgtaaatgtgtgcttgtggcttgcagtaaaattcctagtgaaacattacctctagattcagcagtactatacctcaggccacatggatgtaagtaaagatgatgccctctggaaaactgagttaggcaacaacaagtgcatccatgaggatgcaaatttcaatgttgaaggtgcctgtgaagaatttgaacaaaattgttgcatgaaatatgaatgaagaagtgtgatctaatgacataatattttgtactatataattttaaagtagtacacacaatcaaattaatgaattaaacattatatgtaaacaggtgatcattgtatctccattttctaaagtttctatgttaaaggtgatcaaaaaacttggagagagggacttctcatttggaaaatgggatagtcacctttgggtatgtgatgtatcaatctctagaacttcagtttcttcattgaaagcatataaaaggcaatccaaaggatgtatggaatattaaaagattccactgtgaaactatctagcactttacctgaaacacttgttagatcccctcaccaaaatcatgccatgtgatttggcagtctattcctcttagcgtaagagtagcccgacagaaaatgttcattaagagttaatgttaaattcattgaatttagcaacacatgagtagcgcttcctttctgattatgcaaatctctcaccatcgtaatacgtgcttcctttaatttcattgggaacatttgtaatgtaaatggtaacagagccaatatttcaaacagaagccattctttctaaaaaaagctaaatgtctaaatgtattgaaatgcttctaaaagtaaaatatttagcacttatttgcagatgggtaatgttaaatatctcactcattattattactaccacttgtctgaataaatcctcccataagcattaagcaagtaggtaaacaaagaaataacacttcatgtgatgaatgccaatatgaagcacgtttaaactgttctgtcaagagacaagcctggaaatgctaactgtgtttctttgcttttctgcaatcatctgaatacataaattcaaattgcagcttttaaaacttcaaatcgaggcttttgaaatttcagaaaacacatgcgcttggaaaagcagattataacaaggtcccaacgggattttgtcaccatcttttttatatttcaaagtataaaaaaaatctagataagaaatgactaccaaatgttttcatatttaaaagatgctgtttttttaaaaaattaaatcactggaaaaaaagttttccacaaatatcgtgtaaaaagaaagacagcaaaaagcttagccaaagcttttactgtttaagtgatgatttattctgagagttcttaagagttttctaaattagtatatggttaatatccataaaatcatatgcaagatgctgtctttcaaattgatgctgaaggttaattataaaatgtacttaattatttatagtgtcccattgagtcccagatactctgtgtccaagaacactgtaaatacagaaagtttagcagaattatattggaaaggcagtaattcttcacaaattaacttattgatataatgcaatcccatttaaaaattttcagcgagaattgttttataatttgactgaatgatacattacataagttagaataactaaagtgggagagcgggttaacctaccagaaattaaacatattttaaagctgcaataattgacatagtgcattactgtcacaaaaatctacagtagatcaacaagcagaaacttaaaatatcatgaagaaagcaccataaatcaattcagaagagatggtgctgggggaaaaaatatcagtttctgaaaaactcttcaaggttagaaacaacactatataaatttaagatggattaaatatttggttgttcttttttaacaaatgaaagagtaaaggatcaagaataaatgagaatatctgaacaatggtaaaatggccacaattttaaggatactatcaatgaacataatatcaaagaaataaactgttaaattttatttagaaaaaactactaaaaggcaaaaaggaagctggaaacgtagtctcaattaatctatgtttcagataatgtgaaaagagctcttaaaaataggaaaacacaggaaaaatgggcaacagacattgccgataattgacagtggaaactaaataaatgacaaacatgtacacacatacaacattttcaactttcctattagtagaatacttaaaatatctatggcaagctttttatttgttttattggtatatcaattataatgctcaatagtggcaaaagtgtagtgagacaagtattttgtaactgttggtgggagtttacgagtgttctgagtaccaaccttgacagaaattcaacaatgtgtatctaaatccttaggattcccattgttaacttttcattctcattccagcagatacatgattcaaaatgtataaataaatgtgtttattgtagggttattcattataataaaaaatgaaagcaaacaaaattcctaataacacaataatggtgaaatatagggtacccctatatatcttattactaggatcttaaaaaatcaagtttttaaagcgtaattaatgacctacagagacacatagtagaataataaatgaagaaaataagcatacaatatagggtttgaacccagtaatacatataaatctcaactatgatgaataagcacaacatctctcctctgtactggatattcttgatagaaaaaaatatgctagtaaataatttgagacatatttgaaaagaggggagtgtttgatttagaattttctaaacttgagggttattattatttttttggtttgatattactttttcctgctccttaaatttttgtttgtttggggggtttggggttttcttttccttaaacgtgtctgcttctagatgaaagttgaaaatgtttaaaagccttgccaatgtgtctaggtttttcaaatgtaatcagattttagcaagattttacttaactaaaagtattcagaacactgtgcaaaatcatctggagtcaaatagtaatggaggcaatgatttgcagagtagaaacagagagagagaaaaagatgagatagaccctcaaaatctagacccaaggaattaaatctgcttggaacatttaaacaaataaaggatgcctgtactatactagacgttttcttcttccacaattgattctaaggtcagaatctgaggggaaatggtgctgttccacattctaaaacaaactgccagcaatcgagaccagccacttccccatagggtttactctaaagcaacagggattattatctctattccaagcaatttccaatctcctctgtactccgtgtcccaggcaagattaaaaagactcaggtaggaaggggtagtaagctttgtggggagtgcagtttgtggtaagggacagttccttctctttcatctctctgagtcagaagtagagacttcgagagaatcactgagagtaagtatgtagactccaagaaggaaaaagcatcctctcacttcaatgaatgtttggaatctgcagacctccttcccaggtctgtgtagcttttggagaggccagaagagcaccgtaggcattcctttggctttccatggccaagcacatagagtagaagaagaggaggaaccgtaaggttaaccatacataagaaatcaacaaaaggctttgaaattgacttttcctatttttcaatttaaataagagagaattgtcaatgattaaaattcataaaacgaagaaagaatggactcagaaaatagcaaacatgaaatgttaattattagttcaaaagttagtttaccgtgttttctctgccaactgattgctaatgactaaagtccttatttccagctttcctctctccccgagctccagatctcttgatttattaaactagtagtttccccaaaatatatgagacaacaaaatatactctcagctgaagtaaatagcattcatcttcccagtcagataaggcagaagtacttctagatcagatgttatattcgggataggttaaaaacagaccctgctcccagtgtcccaggaatgaacagtggatgtgcttatttctcattgcatgcgtgtatcaaaatatctcacgtaccctacaagtacatacacttactatgtccctacaaaaattaaaaacaataaatcataaacatttgtaaaaataagcgaataaatgtataaatgaatttaaaagagaatagacagaggggagaatgtaactttacgtgtcccagaacagactttgaacaggctcttatcatataggaaaactgaatgaatatatgcaagcataagtccaataaccagattctgatttacagaatgatcgcaactgtagttctctcaaggccctgtctttgaacaggctgtgtcttattcctgcaacatgctgatctatcttcatgcttcaagactcagatcattatcttctctgggatgtctcccaagcactgccccagaaataacttctcctcctataatacttaatcataatccttggcttacatgcttgtttcttctcattgactatgaaatcctcaagacaaggtatataacgtatatatctttaatcctaatgcccaattgagctcttagaaggtagtaagctcccaatacacatttgttaatttgaagcaaaaaaaaaaaaatagctaatcattcaaaaaactgaattatcacaaatgtccatctaaagtactatatttacacaattaaatgctatacagccaggttaatgaacagactaaaattatatgcaacatggattatcgtaaacataattttgaatgaaaaaggcgagacacaaaggagtataaagccatacaattccattttcataatattcagtaccggcaaaataatcaaagttgacagggtactggttatacttggaggcagtgactgcaaagggataagaggagatttctgagattctgataatattctatttccttctctggttgtacagtgtgttcaatttttaaaacactattgggctatacagttaaattgtgcagtgtcctgtacgtatattacacttcagttaaaagcttccatggaagctacacatagttcccaaaagacaacaaaacaaaaaattttcaattattttaagcacaaacaattttgttcagctgtcttacaatcgaatatgtaagaataaatttatggctaattagcatagagttatatgcattttcataattaaaacttccacgagtacaacatatgttaagtattttaaatcagtttttctctttcctcaaataaggttgtgagtcataattcggaaaacagtttagcatgtaataatttagtgttttattttaaaccaagctgaagccacataaagcagaactgctcaactgagccctatccaaatccttgacccacagaataagaagcagataaaatggctgctacttaaacaaaacaaaaaccttgtttatatttttgtcctctcattttccataagtatactttaattaaacattttaaaacttgtaactttaggttatatacttactttagttggttctcaaccagggacaattttgtccccacccccaaccccccagcatatttggcagtgccttgaaacatatttggttgtcacagctcaggggcgaggtgttactactggtatccagtgtgttcaacaggccagggatactgctaaataccctacaatgcagaggatagctgctcacagcaaagaattttccaaacctaaatgttagtaatgctaaagttgagaaaccttgctcagatataatgacataatgttgttagaatttttattttattcattttaatgtatgtatgtatgtatgtatgtacgtacgtatgtatgtatgtatttgagatggagtctttctctgttgcccggggtggagtgcagtggcacgatctcggcttactgcagcctctgccttccacgttcaagtgattctcctgcctcagcctccctagtagctgggattacaggcgcctgccaccaaacctggcaaatttttgtatttttagtgtagacggggtttcaccatatttgccaggctggtcgcaaactcctgacctcaagtgatccgcccacatcggcctccctaagcgctagggttacaggcatgagccactgcgcctggccaggaatttttgaatcagaatttttcttgttcgattttaatctcttatcatttagagattcttgaaatattgaaattactttgttcaaagtgaatgaattttcttaaattatgtatggttaacatcttttaaattgcttatttttaaattgccatgtttgtgtcccagtttgcattaacaaatagtttgagaactatgttggaaaaaaaaataacaattttattcttctttctccaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaaggtaattttattttctcaaatcccccagggcctgcttgcataaagaagtatatgaatctattttttaattcaatcattggttttctgcccattaggttattcatagttccttgctaaagtgtttttctcacaactttatttcttcttaaccctgcagttctgaaccagtgcacataagaacatatgtatatatgtgtgtgtgtgtatttatatatacacacacacatattgcatctatacatctacacatatagatgtatagattcaatatgtctaaatgtatataattcacagtttttatctttgatttgaaattaattttagattttacttgagaacttcacaacttcatataattttaaaaactgaagaccagattgtggaatcataaaatctaaatctaaatgggaatcacttttttaatctgtcctggttacctacctggagatttgagaagagtctttaaaaagaagaatccattttcttagggaagatctggattgccagatcagtctcaccacttcagcctctacttaaaggcattatattcccccgaagcaatgttttgttttagctgatttgtctgggggtgtgggacgtggtgttggttcacattccatttggttgaatagacatccagcttattccagtggcttttcataccgtcctactgtgatgtctgcttattactgattacttcccttggctgactgacatgctctgattgtgcaattggattaactttcatggttttagttttaggaaagcagctcttttggatctatttcattttagttgtcaagcagaaggtgaaaggggaagagaaattaatatttaatcattccctgttatgtgccaagtattagatacatttacagccactattttatttaatcttcatatcagattttgacaatggttgctattatcctcattttacacggtcacataatcaaagggaaatgaaattggtcctttatcaatgattcaggtgctttacacatgtaaattagagtccaatgtcaaacgtttatttctgtgaaacaagaggtttacacctgaacaagaaataaagtataaaaataaaatatggcgtaattcaataaacaaatatggagcactgactatacatccgatgttttactaggtatttgggattcaaaaatagaaaagagtgggaatcatttgaagatggttataccctagaacaatgaactcagtcttttcttggaaatttatctttcccaaatgtattgagtgtcatatatagtaatataattgataattcattcgaaacatatttagtggcattttcttattaattaatatgcatgagtctattttctcctgaaagaatctagatcagtgctttcaaatagaactcccgtgatgatgaaaatattctgcatcatccatttttgtaacgactagctatttgtgccttttgaatacctggagagttggtcgtgtgactgaggaacttgagattttattttagtgaattttgattaacttgaatgttaatagcgttgtatggctaatgggtactgtagcagacacagtaactttagttgacaaaaatgaagtgttaacaccatggtgattttggaggtcttgggaaagggcatacactatgtggtggtgaatgagttcgagaaatttagggatatgaagtaaaaaatgaggactccagaatgaaactacccaaatttgaaccacacctttgttgcttgctagatttgtgtcctgggagctggtatttaacccctttgtctcagtttccttccatataaaatgaagataattggatctacctgatataattattataatatgaagataaactaagataataaatgtgaaaaggttagcacagtgcctggcactgtgtatattgagagtcaatactctcaatgtcagttacctcttaagatgataatgcaatttctcagcagcaagctacggtatgctatggcatgctatgatacccaagaggctgatgaatttgttcacattgttctatttctgatagagagataggttttcagacactaactttatttggagtgttgctttaccatctcacatttttctcttaaaaaatttatgagggataatataatcgtttattttctacagagatttatctactgagggggtgagtgtttcagtcaatcagctctgtgctcagatagaaaactgttggtatttgaggtaccactgggccctcggtcaagtcgcttcattttgatagactaatcaatagaagcaaagacaaggtagttggaattgtgctgtaattcattttaaacgttgttgcatttgtctgtttcagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggttagacattaaccatctcttccgtcacatgtgttaaatgttgcaagtatttgtatgtattttgtttcctgggtgcttcattggtcggggaggaggctggtatgtggattgttgttttgttttgtttttttaacctgaccgtttgctttggctatatgttttgttgtggctagaaaaaatgatgatggtgaatggctttacattaatgaccaaatgccaaaatttataccacaattttttgcataaattattctgaagaatcagactgaagaaatggcgaagtatttaattcagtggccaggcatgtactgacagtatttaagctgaaaggacgtggtctggttctagttaaacaagtgtcataaatcaaaattaattattcacacctgtggtatggacttaataattaatgtacactaacgttcgccacaagtttatttatttacttacctactgatttattaacttgtgagttttcatctttccaccttgcatactatataaatctaacagtaatactatttattaaattaatacatatttattttatataaagcaagtggtacatatgaatttatagtaaaaagcaacatcaattgatccagcactattcattcaaagacaatcatttccccactgtattttcatggcatctttgtcataaatcaagagaacttgtatgtatgaatctgcttctggattctgtatcctcttccatttgattaaatctgtactttaacaacagtacttcactggcttaattacaatcttttttttaaaacaatcctaccgagctataattcacataccattaaactcatttaaagtgaacaattcaatcgtatttcggtgttacttttttaaggtgtgataaaatatataacataaaaaattgtcattttagtcatttcgtgtgtccagctcagtggcatttattacaaccatcaccacagtttatgccccacccccaatttttttttttcttttttggagacagagtctcgctgtgtcgctcaggctggagtgcagtggcgcgatctcggctcactgcaacttccgcctcccaggttcaagtggttctcctgcctcagcctccctagtagctgggattacaggcacctgccagcatgcccagctaagtttttgtatttttagtagagatggggttttgccatgttggccaggctggtctcaaactcctgacctcaggtgatccgcccaccttggactcccaaagtcctgggattacagcgtgagccaccgcgcccagcctccaaaattttttattactccaaccagacagtctgtaaccattaagcaatagttcccctttctctctcttcccatccgctagtagcctctggactactttctgtttctatgaatttggctattctagatcttttatataattggaattatatatttgccactttgtgtctgccttacttccctcagcataatattttcaaggttcatctatgttgtagcatgtgtcagaacttcattcctttttatgactgaataatattccattgtatgtatatacgcaatcattttatttaaacattttggatctggttgtgtaaaccttccactttgttcttcctattcaagattgccttggctacttttggttctttgaataaattttagaactatattgtctatttttacataaagccttccaggatattgattgaaattttgtgaatctggagctcagtcaacatctttacgatactgagtcatctaatttgtgaacattttgaattgtgtcaggttatttattgtattttttaaattggtgatgctgacattctaataacagatcatttacacgactgataaaatatttaggaactaaaataagtaccaattttatgacattaaaaccataatgtgcgcttaagtgtctctatttcaagcaggtagttatttgaaaaaaaaaaatcccttcttggtttctacctttaatgattgcaaaacatctgtgtaaagatacagacttttatgtatggagggaaggtggtgtcccagcaattaaattttatagctacataacaatacaaatgaaatcatccctcataaaaagagaacaaggaggaaggatacccaaaatgttctacaatatctcagtacatcttatgacaaaaagaagaacaaaaattataattgtaggaaatgtgagagaactatctaaaatatacaatagcagctttgtgggttgtgaaagagtcaaggttttatgtgtcctgcaacagaataaaaagtcaaatttttatgatagaaaattaaaactgaggttacgaacaccatcatgtatagacttatattactacagcatccataatatctgtttcctatgccaaaattataattttaatgcaatgtctttgccattaaatgccacaggatttggaattttattcattagtcatattaaaattatttaatcatcttttctccatccatatgcctctgtatccctgttagtttagatttagggatagaaagcaaatgatcagtaccagatttaggtaaataacacaagtttttttaaaagtaaaagaaaatggcttataacactggcagacagtcttgatcttcattaaatctcaagctcttacttattacaggagggtagaaataaagcggaccccctccctgtgtcctccagccctacccttcatccaaaggttagagtgggtgatataattggaactagtgggtcatagttactgtgacatgaatatgtcaattccttagtacatagtatctccaaacatatcctaatatcataatcagttggcaggtgactttctccacagctaactctaatatgctgcattctgcgtattgagccaactgaccccttactcttgtacctttattttatttttttttttatttattttttgagacagagtctcgctttgtcatccaggctgcagtgcagtggcacgatctcagctcactgcaacctccacctcccgggttcaagtgattcttctgcctcagcctctcgagtagctgggactacaggcgcgcaccaccacacccaactaatttttgtatttttagtagagatggagggttcgccatgtcggccaggctggtctcgaactcctgacctcatgatctgctcacctcagcctccgaaagtgcggggattacaggtgtgagccaccgcgcccggcctgtacatttatatttcattactgaagagagaaaacagcaggtgaagataatatagctatttctttaagggagtggtggacagggttgctttaaactgaatatagccattagcgtaaatttatgggtagcttcatgcaatgaaggctcatgaaatgatatcctcattcttgtctaatacataacttgaccttttacagcctttaacaatgatacccgtaagagccacaaagtggggatgttattaaagctagcctctgtgttcctctctctgatcatctcattctatgatcttcacccacacttctgactcaggtgtttttaatatttatccctcttcatatttctttgtattttctctgaacatgcatgtgggtgtaggaggctctctcgccatcatcatcactctcttcctctgtgtttctcacttttaggctaattttcatctatgaattgacacgtatattataggaatttatttttatatatttattaggaatcttctttttgttttttttttttttttgagacagagttttgctctgtcgcccaggctggagtgcaatggcacgatctccactcactgcaacctctgtctcctgggttcaagcgattctcctgcctcagcttcccgagtagctgggattacaggcatgcaccaccacgcctggctaatttttgtattttaagtagagacggggtttcaccacgttgatcaggctggtcttaaactcccgacctcaggtgatctgcccacctcggcctcccaaattgctgatattacaggcgtgagccaccgcacctggccatgaatctacttttctatttgcatatttgccactctttttctgccccagttgtttatgtaacacattctcttctgctctccttccctgaccccgttaatcccagtttcatctctttcatgtctttttattttgtgtcccctttcctcattcttcattgctctttgtatatgttatatgtgggtatttttttaactacccatttatttaaaaccaaaatatgctttatcattctttatttttgaacaccgagtcctagaaaggttatgtgacttatttgagaccatgtagctttctatttaaatataaaagtgattccaaaataaacagtaggggttttaaccttttggtgaagctcaagtgatttttatgtggataatatcctaatattaaaatggggatttattttcttttaaaaaaactatatgagtttttgctttggtttttgccctttttgagaactagatgctgtgttttaaaattactttctagaaccttctctgctgtggaacatttacagttgtgtaatatagcaaaacatgtttatgttgtttcagaattagttaaaatcctactatttttaatgtcaagtaattttacaggtggtgtacgttatgcattcctattagttttaataaatatgttgtcattttgttaaataagtttaaatttttcatcgcattttacatgtaaacagtaatttactatctacacataaaataccatttacaaataagatatactgtttatatgtaaatggtaaattactatttgaatttgttactgcccagacagtataaaatggtgcacataaagaaaaaagcattttggaaaacaattaagaaatttggctggaaagtgaattttagttaagtgcatcttattcactttaccgaggaaaaaggtaggtttacaaatacaacatatataacaaacctttaatatgggaataatttttgtaatattgataataatacaggtattattttcaaaaaatcaccaaataaaaattatgaaagtaaaaatacagtgcaactcctagcacaaactatcttccacaatatacagttggctgtatctaaatttccagaaatctggttcattttgtattaatctctaatcatgttgcttctaaatatgtatctgaggagtaaacatttcagatttattttcatttgtataaggtaaatgaatgtttagtctttttccagacgtatttgctatgtaatgacagtcattattagtcgtcagtataaatgtgaatagcaaaaaggagaaaattaaataaagctagagcttggctttccgactccttgctcaaaaatggacactttgtccaatcaatttcctatcacaagatgacgattaatagattgttctaatagttaccattcagtcctgcccttaacgtgatgttttttcaaccaaataatagaatcttcactggcattgttaccatattgactggtatttatggaaccccggaaaaaaaaatgctgtaaaatatatagtaggaagtataataatcattataggaaatcatttctctagctggaagtcttagcagggaccagatagttccactggagcttttatgtgctcatgattttctcccttgaagtgtatttgtaacacagttcacacagtttttaattttataaatctgtgtgctaaaacgctattatataagaaaacgggccgggtgtggtggctcacgcctgtaatcccagcactttgggaggcccaggcgggcagatcacaaggtcaggagatcgagaccatcccagccaacatggcaaaactccgtctctattaaaaatacaaaaattagctgagcgtggtggcatgtgtctgtaatcccagctatttgggaggctgaggcaggagaatcacttgaaccagggagtaggaggttgcagtgagccaagatcatgccgctatactccagcctggcgacagagcaagactctatctcaaaaaaaaaaaaaaaaaaaaaagggtgttcacctatttattgggcatatagtctgatagttcccagaaacccattatcttgaatgttttctttatgtaagttcctggaaatccattatttggatgttttctttatgtagttaataattacagcaaagctgtaattaaattatttattcaagagctatctattaaaggactactatgtgccacattctgttctaagcatatcataatcacttcccacccttcccttatttaaaggacatgcataattttatagggcttggcattataaatattcatatctctaatttatagttgctaaacagtttgaagctgagggttgggggaagggagtagtaatttaaagtttataacataagcatccttgactttgcctcctataatttcacactgacatgaggtttattactaggttgtgtgtcatgagtacatctcaatttgctctgactgttctggtttttgcctgttatcctatcataatttttaatagctccctctttcattgtcataagtattccactttagaagataaaatatatagagagggtcactctagttatgagaacaaacatcaggcttttagagctaggcttggtccagtgctcaataactattattatcatgattgcttttgttcttagtagcatcatcgtccttgtcatcatcatctaccttcctaatactttagttcagctgagaatttcggcctatccaagaaatctgattgccattattaccgaattaatcactctttaatgacaatagtatataagaatacgtgacatttaactttccaaattattgaaatgttacgctgtgtatggaaaattctttctaaccgtgttttttctctactctcaaatcgtaacaatcgtcaacacagaagaagacttttatgaccaaatttgtggaatttttttccccatacaccaaacagcaggcaccagctgggtgtctctaattcagtcctgacactatccacccagagatagtgtcagatcccatagattgagggctcagtaccgaggtctgcctcctctgcacccccctagcgcacgcgcgcgcacacacacacacacacacacacacacacaccagtctcaagtccaggcctctggaacttctgacccatgggcttcaagttggggttcccatgaccctctctttgggttcaactaacttgctggagcagctcacagaactcaggaaaacactcgctttcacctgtttatgataaaggatattgcaaaggacacagatgaagagatgcatagggtgaggtatggttggggtggagggacggaaaggggcatggagcttccatgccctccctgagtgcaccaccctctaggaatccccacctgttcagctacccggaagctcactggactctgtcctctttgttttttatggaagcttcatgacatcagcattccttccccaagggtatatggtgggaccctctaacaggaggtttttaagacctataatctgaaaggcgagggaacattaaagtgaaaggagagcaggagaaggtcagaggcctgcccctgagacccaacgcaaccaacattataacaaaaaactgtaacaagggctatgggtgttatgagccaggaacctggatagaaaccagtatgtactataataccatataggcaatgccaagaatatggatcagacactttacaaacaaggaaaaagtaaacaggagtgatgaggaggtaatttactgcaggcattaatgatgagattatgaattatggattccacttgctaccagctatgtgatcttatacctactctgtccatacctaagttataacatccataaaattcaaatactaaaagaagacacttccccaggttgtggtgaaaattcaatgaggtagtaaatgggaaatgtgtaacacagtatctggcatattgtaattgctcaaaaaatgttagattaaaaacagtaggagtaatactaaaatagaaaaatgcaaagagcaagcacaaaatcatctctgattctcacctccaaattctccaaaagtctcaccttcttaatcaaagttgtaaatatggctcttggggagaaagctgaactatgtgctactattatgaatgcaacaggtgaaggagaggagagttagaggcagcaagacaaccaaatggctctcgtggaaggcacagaggattttcagccactgctctcctattccgctgatattactttcattttctatgaccaactagcatttcagctaaaatgtgttggaaaatgatagatttttctcctcctattgcctaagaagcccaacaaagccagcattgttttcaaacaccagcattctcacttttaaagtatgaacataattcagaggacttttaattctgaacatcgtttttatcaatctattggcctgattgtaacccagaaatccaagcagaaagcaagtaaactttcacactgcttccccatcccttccccctacctttatttttgacatcagtttccctcattttggcaaagtaaaggaaaagcatttgtagaaggttacactgaagctagataattttctattaggaaacctcaccaaatacaagataatttgttcattccaatataataatgttttaaaaaatataacaaaaatccagcataaattgtgaagcactgatacttgtgtaacaactaatttccatagtgaaacttcattgttgccactatctacatactgaaaatgtatatcaagcatgtaaatgtgtcacttaagtatgctgtgccctagattttatttaaaagttaagctaattttcaactaaaaacaaattcgactattcttagcaatctctcctccccgttcatgatggatttaaaatgatgaagagtataaatgatgatgaaaagagaaaggaggagaaaaatttcataactctgcatcttcagtgtagcatttttaagtaactcctttattagcacaaaggtgtttgcctgaagcaatgacttctagaaaggagaagaaatgacataataaaaggggattttgctaatataaaatgttttttctttccttttgtttctgcaatgcttttacttacatagcaccaaccctgagactagagggagtttccttcctttctaataatttaataatcgtgaaatgatattaaatggaagttttcatatgccaactccttaaactgaggttaaataaggaacaaagattaaaggccatatttaagaccacatattgtaaattctaacccagtttcatttattatatcacctgcaaagccaatatgccatacaaaagtaaaataacagggtgatttttattaaagatcagaatcataccaaaaatgaacttttctgtcaaatctttatactcatacatcaagatgtgagtttatttatgtagctaaaataacttaatactaaatgctgactactatattcatgtcagctgacccctagtgcttcaaaccatagaaaagggataccaaatgctgggttggttgtgtattccatttttgccgtataccacctgccaaggcttataacagatctgtaatgggtttcttaccttttattgtgtagaaaatggattgttggattaggcctggggccagtgaaccatggaaccccaggtttgcaagaaagagtttatcaccctttgatgttatttctgtctcgtgtcagctgagaaggatgagctagattatctgaaagtaagctggatgccaaaatcagcattcccctcatttatccaccttatggttcggggcaagaccactgtatgggtaacaaaagggctgataagggcctgatggagaaatttggtttttctcccttttgattggcttgctgatattagaaccaattacaagacattgacgagagcatttcattgtttgttgctagagaaaatccatcaattttgttgtggaaatgaaagcatttgagctgaatgttgcacttataatttgtgaacattttcagttatcaccgggacaagtatagtccatctttggcatggttggccaagtgtggtgggaaaagagatggaccagcaaatgggccggaaaccaaagtcatcaaaagggtatttcaagaaaactctatttgttctgatggttacattctgcaggcaacctgtgactgatgactgatgcttatacctcaaatgcagtctaaaaatatttttttgtgaaagtgacacattctgactgtgatgtgggtgacatcaacagttttgaataggacagtacttcttggacttattgaaacttttataaaagaatgaacattctgaactcaattgcaatgtaaatgactatcatgaagattgcttctgttggtgctatgacttttgtgacaaattttagaccattgcagttatctcctagaggttgctttattgttttattttcatcagtgatgtgtattttatcagtgatgttagaatcactgagctgctggttaaggaagagaaaaaaattaatattcaggtgctatataggcccttattcattgagaacaaataaaggccaacacacaaaacaggaaaattaatagaaaagacactctatgggtaagatttcatatagtttgggagcagacaaaaactattttaattactaaaataattaagaaagatgttgaggctgggcacggtggctcacgcctgtaatcccagcactttgggaggccaaggagggcaggccacttgaggtcagagttcaagaccagcctggccaacattgtcaaaccctgtctctactaaaaatacaaaaattagctgggcgtggtggcacatgacttgaatcacagctacttgggaggctgaggcaggagaatcatttgaacccaggaggcggaggttgcagtgaaaggagatcacgccactgcattccagcctgggcaaccgagtgagactctgtctcaaacaaacaaaaaaaaaaagattaaaaaaaaagatgttgacattaacatgttcaagtctttatgctgaaactagaatgcagtatgattaaataatcatttctacttcgggtgaaggattagttttcttaaagatacccctttccagcttctcagttcgcgtgtggttaattcccaacgtggcctcaaatattctaatggtttgtgtaatgagtgccaccgttccaccttcttattctccatgcctcatctcagtcctggaaagatcactaaacttgcagttcataactcagtctagacccaggttcaacactcactaactcataactgtgggccacttatttaaatctcttagtgcctctagttcctcatttgtccaacagtgatgcattatgaagcatgtttgcccatctcccagcgtctagtgaggaactaaaaacacaatatatactatcatactttattacgaggagttaaattgtggttactattacaaagtaggttaccataaaattctaatagcagtggtaaggggtaaagatccacgtgccatcacgtagagcagaacttctcaaactttaatgtacggcaggtccttgaataatgttgtttcattgagcatcactgtgttataatattggcaagggaaaaaactgtatctcagctaggggggcactgtctatgtggggttttcttttgtctctgtgggttttcttctagtactctggtttcctcacatgtcccaaactgtgcacgttaggggaattggtgtgtctacattgtccccatgtgagtgtttatgtgtctacgactgtgccctgcgatagaatggcatccctgccagtgttggctcctgtctggtgctctgagttgccaggatgggctctggcctcccaagtccctgaactggaatacgtggcttggaaaatgaatgactgaattaatataaattactgtgaaataaaaattcatatagtattcaataatcataaagatgcgtgacaataattgatgctctacagaagtgctcagtgagctgccatattgattattgtttgtttttgaactttgtggtgagagaaggcaatcctggcagtttatgctttgcaaacatttattccttgaatgaaccaccgccactgcaaacactgtcactcactgattcaccaaaaactgggtaaataattttcctcctggtttttattaatctttctaaagtggatgtatatctcacatttatttctgagtttaatattagaagtgcttggggtctttatttagatgttggatcatgttttgtgaacacaggtatgcagtaggaacttaattcttgtttatcaattagcctatggtaagattggtttcattatatgtcattttgcctaagtcacagtttcccagaatctatcaacaacattaattgatgacttactgaaacaggaatcaccttgagatcttgttaaaatcaggttactgattcaatggctcttgcataggacctgaggttctgcatttccccccctaatttcaagatgctggttccctggtccccttgctctacttcttaaatggtagggaggtagagagtggctatcaagagtctgtgtaggagttgaccaccaatcccattcaatggaatgcatacagtgtgttctgagatactggaaaggcctttgcaaaaagattttgtctcttgatatttatgaagcacattcatccgaccacagaagatacatatcaactttgacagaaaatatgaacacattcaaatgatttatacctttgaaacatagatcgttgtggggttcataacccaagtataactttcccacagattcactcaatttccttcctctttctgtgcaatatattgtatattgcaagaagctcacctccactcaccttattcctcaggctttcttctcaactatcttctgtatagatttaaccagtgggaggcgttggcaggagattggagagcaggagaaggggagatttcagggtatttctttccctctttcactgctttgggcaacagctgatacagagtaagtggccaaaaaatactagctattattaggtcttctaataatgatcttctaaaatcactttttcagtggttacccccattgatttgccatgaatgtctcttcagacatctttgcaaagaattgagcctgactttagatactcattcaaaatcaaaatcagtaattttaggattgaggactctggtattatttaagaactcttaactgtaccaagcctcactcccatttctggctttcccctatatatcagttaagtaataactccaatagtgtaaaatttgcaatagtgttatgtaacaaatcaccctaaaacttattgacttaaaattatcaccatttataattgcacacagtctgtggggtcccgtgagctgttgtgttgttctggctcactcatacattttcagtcagctaatgggtgggctaggggctggcttatctagcataagcgcagctaggatgattcacctctgctccatatggtctctcatccttcggcaagcgctcctgggcttattctcatgcaagaaacaggattctaatagagaaggaaacaagacttcttgaagcttaagcttggagctggctcactcatttctaacacatttttttaaccaaagcaaatcacaaggcaggcccatattcagggattagggaaataggttacaactcctgatggtagcaactttaaaagtcacattgcaaaaagatgtgcatacagagaggtcaccagtgcaatctaccacaccttgcaatctattaagtttctcaccccctcacaagtaaggtattcagttaagatgcattcctatgtattcagatttctaatcaactaatcctgattctcacgtaatattgacacagtatcaatattctcaaaagccaatagtctagagggtcacaaagatcctcaaagatactttatgcaaaatcctaggagtatagaaacagtaccttggtttatgtatacattcagtatttattaagtgtttccaatatggtataatgttaaggaatgaggatagagttatgaacagacagacacttgtctttatggatcttacatttggagggggacaaacattaaaatggattatataattacaaatgcagccgttctcattgtcttttcagatttctcagggtgtagactgagctactataataaaaataccccaagtttccatgtttcaaacaatatagatatgtgtatctttcccacataaagtccagcctaggtacgtagtctctgctctaaaaaggaacacaggctagcaaggcagctatactattctcaatataatactgcatttcaaaatctccatgctggtcccacaaatatccatgcactctctttcttatcatcaagagaacacacagtgccttcccaagagagaccagtcaaagtctcattcacttactgcatccagctaaaagtccattgtctgtggatgatgcactgtcttctccatcagatcaagatatggttcctcatggtccagtgacctataaagtgaaagttatgctatctgctcctaccacaaccaattctctctttttaaaatttttttaaatttttgtgggtacatagtaggtgtatgtatttatggggtacttgagatgttttgacacaagcatgcaatgcataataatcacatcatggagaacgggggatccaccccctccagcattaatcttttgtgttacaaacaatccaattatactcttatttatttttaaatgtgcagttacattattttgacgatagtcaccctgttgtgctatcgaatactgggtattattcatttttcctaagtattttttgtacccattaaccatcccgctgccccctccccgactcctccactatccttcccagcctctggcaactacctttctactctctatgtccatgagttccattgttttgatttttagattctgcaaataagtgagaacatgagatgtttttctgtgcttggcttattttgcttaagataatgacctccatttccatccatgttgttgcaaatgacaggatctcaatcttttctatggcagaatagtactccatttgtgtatatgtaccacgttttctttatccattcatttgttgatggacacttaaattttttccaaaccttggctattgtgaatagagctgcaataaacatgggaatgcagatatttcgtcaatatactgatttcctttctttgggtatatacccagcagtgggattgctggatcatagggaagctctatttttacttttttgaggaacctccaaactgttctctatagtggttgtactaatttatattcctaccaacagtgtgcaaggttttccttttctccacattctctccagcccaggcacaaagacagcagtaagtgctggacgaccacctatgcaagacctagactataaatccagtacttctctccctctccacacccccatacccaccactccattctgagttttcaaatgtaagctaagctaaatgattcaataaagctttttgaagtcaaggatgagaaaaatcgttgctttttatgtaatcccaccatcaaagtaataattgcttagttcaaattgtggtgatgcaaacaaggaaagcaagagagcataaaacgggtggatctgacgcagtccagaagtggaggcaatggttgtttttagataattattagagaagatactgtgatttggtttgaaggcaaagctcactgaagttctctagttctagatacacctatcgaaaaattcttacccaaataaatgtctcagtgataagagcagcctttccccaaatgcctaagtgtttttgttttgtttttgttttgttttgttttgttttgttttgtttttgtttttgttttttttcaaaatcttcctctggaatggatgctgaccttgtcattgacttattcttcaccacaactcagtcatattaatcttgaaagagacagagaggccactatctctgctaataatttacataattgtttttctacaatttggtgctaattaaaatgtgaaaggggtagtgatgatataggtaaatgtaataaggtcattctttgttcctgagagcaaagataatgtcaccagaaaggattgtctgtatattcacataagagcaggaaacaggaagagagacacagtaaggtaaaatagcatactagtatatcacgtagtctggtatagccaatgtagaatatttatttcaaaaaacaaataaagataaagttctgcttcactttgagaagctgttttttttaatcctgtatagttagttcgacatgttactactctgcctggttcaaattttgatttcactctgttccagttatatatgctatgcaacaaaccactctaaaagttactggcttaaaataagatagttttacgatttctcataattctgagagttgactatgatattcatctgcttcacctgatatcaaccaagacactgggaaagctggaaagtccaaaatggcctcactcacatgactggcagttggtgctgcctaccagctgagaactcagctaaagctattggccatgagcctcagtttgtttccattgtcttctccatgtgtctcctttggcttccccacagcttggtggttgagttctgtgaagaagccttccaaaagaacaagcaccaatcttcaaagacttatcaagcttctgtttgtatcacacttgctactatcccattggccaaagccaggcatatggccaagttcagaatcaaaatgagaagggactacacaaaggcatgaatccaagaggcgtgattaattgtggggctgccaaataatcgccttccacaaattccttactagctgtgtcatctctctgtggtctcagttttctcacctggaaacaggaacaaaaatggccctacaaaaatggactgagatatattaggttggtgcaaaagaaattgcagtttgggaccgtgaattttaaatcattataactaggctcaagcacatctttattaatcaaagtaggaaccgttacagtcaacacatttttgccaagaagaaataagtgtgtttattcctgtagcataaaaattcatgctttgggattcaatgaactcttggaaagcattttcttcatcctgctagttgtggaagcattttccctgtaaaaagttgtcgagatgcttgaagaagtggtagtcagttggttgagaggtcaggtaaatatggcagatgaggcaaaacttcctagcccgattcattcaacttgtgaagcgttggttgtgcgacgtgcggtcgggcgttgtcacagagaagaattgggccctttctgttgaccactgctggctgcaggcatggcagtttttgatgtatctcatcaatttactgagcatacttctcaaatgtagtggtttcgccgggattcagaaagcggtagtgggtcaggccagcaggagaccagtgaacagtgaccatgacttttggtacaagtttggctttggaaagtgctttggagcttcttctcagtccagccactgaactgggcatcgccagttgtcgtttaaaatccactttttgttgcacgttacaatccgatcaagaaatggtttgttgttgttggcgtagaataagagaagatggcacttcaaaatgacgatacttttattttcgctctgcttatgaggcacccacttatcgagttttttcgcctttccaatttgcttcaaatgctgaacaactgtgaaatggttgacattgagttcctcggcaacttctcgtgtagttgtaagaggatcagcttcgatgattggtctcaatcggtcattgtcaacttctgatggccagccactacgcccctcatcttcaagactcttatctcctttgaaaaacttcttgaaccaccactgcactgtgcgtttgttagcagtaacttggccaaatgtgtttttgacattgcgagttgcctctgcttctttacaatccattttgaactcgaataagaaaaacgctcgaatttgctttttgtctaacatcatttccatagtctaaaataaacataaaataaacagcaagtaataagtcattagcaaaaaaaaaaaaagtgagaaatgctcattaaaatgatgtataacataatcacatttatttaagaatgtatttcaatatcaaatggcaagttccatgaatgtgaaaacaacacttacttttgtagtcacctaatgacacatttaagaagctgaaacctgagctcagcacatggtaagacatcagtaagtattagttatcataatttttttagtaattttcctacagagctataaataaaatgaaatactttccaaacagtgataaaactataaagcagcaatacattataagcttctatcctaatctgccttcccctcagggccttaaaatgtgtcatttctgtaaatgttacctctgacatgaaagcaccaacacactgttcagcaattacaagttgattgtgacaagagcctcactctccctatttctttttctcttcctgtcttgctttcccttttccccatcctttcactcactttgataaggcaaactgccatgtagtcacaaaatcctagacaaacaagtctgtacctatgtgggcgatgctgtggatttagtaagggaaacagttccttgataaatttctcctttagccctgggtttccaacccctgtgtcattcagctatagaaatcttctgatattttctcccactggtcattttcactcaggctgccatcaaaatgagactacccaatgttctttccatttgttctgttttcttcctcgcctctgattccctgcctggtccacttagaaagtctaccttttttccttctctcttaataccaccaatctctaaatctgacttctcctttctaatcccatagagcctgccttgtcatctccaaacaagatccatcttggcctcctgttatcctcagcccacagcagtatttcacttacaacgttcgttagtttctacctcagatgtgtcaggcatttagtttgtaccaatattttatttctttttatatctacaccaagcctgcactagacggtccaaggagaaatttaactgattcctgttttgaagtcctccccactccttgggagagttaaagattcctcagtgtgttaggtaatgatagttaatatttattaataacttactgtgtatcgactgtattctaagtgctttgcactgttagaaggagaataacctaagactgtgccaaacagcagtctagaacaaagctgaattccttgcttgcctggcaagggagaatgtggtacatactaaaggattaatacatgttcactattaaattgattgattgtggtggtggtgacagtggtgatgacttttcaagtgtgggtaaagtaattttttccaacaaatccacatccacatatttaagaaaagagagacatttcattctatctttttgtgtgcctttgagaggacacccctggcacccaactcccaggcaaatgccaccatctgtgtgattttccttcatttgccaacgaaggcacagcaggtactactaggttaacctttgctttcgcaagtcttctctcaaaatagtaaacacttcagctgttggaaagctctaatctcaaactgcaaatttaaaaatctctctctggagttcaaaaaatagaaagaaaaaataaaaatctctctcttctggaacataatgtttgaactgttacatattattcacactatttcacattatgggattatgaaatatggttttaggtgttagaaaaacgaaagaaaactattatttgttaacactaaccgagagatttttatgatattcaagtaaaatgatagaatgaattattttaaaaatgcatgaatcttcaccttctgtgaagtgtcatggaggattagttctaactaatatgcctgtaagtaactgacttaatgcgtctattggttctcttaatgctgtaagtgacagaaaactggtctcaaactgatttaaacaataaatatgatcaaggttccggttttttgtttcttgttttttttttttttttttcacatttctctgggttctatttttctgtgttgacctagcagcttcacctgacttccctcttggtgacaaaaatggcctgaagccgtttcagaacccacatctgcaaacttacttttgatgaaaatcatctctttagggaccttctttcccaaagcatccaggaaagactgctctgaaactgactggcctgaattaggtcacatgctcattcctgtactaaatcacacctcacttctacagctaaaagtcattaaatctcaaccaaactctacagctgcaccacaacaaaggtagagaagtaggtgcaaagttcctcaaaggaacgtaagggtgaaagatgattgactgataaacagacaggtagacagaatagatagatgaattaggaaaagataaccaaccaatatctgtcacattgctttgacttgattttttagtcaattaatgaaactgaatggtaattttgacattacaacaatactttccaaatgtaggcaggttgtggagatcatttaaggaaaaaatgtatgaggtgttgtagcagatactgtcggtgccccaccgatatccctttagcacttaccatttttatacgtgcttcttaatttccaacttcctgtacttgcatctctttgcttggggctatctctgctcattcttgggagagagcagaaatgtagcagttatgcccctgtagagcagcagttgatagatcaataccctgtcccccttgcccttcagatctaataactccaagcttaattccctacatctttcatataagtatatatataagtatatatatatacttgaagttctagggtacatgtgcacaacgtgcaggtttgttacataggtatgcgtgggccatgctggtgtgctgcacccattaactcgtcatttacattagctatttctcctaatgctatccctccccagccccccaccccacgacaggccccagtgtgtgatgttgcctgcgctgtgtccaagtgttttcattgttcaattcccacctatgagtgaggacatgcggtgtttggttttctgtccttgtgatagtttgctcagaatgttggtttccagcttcatccatgtcccttcaaaggacataaacaactcatccttttttatggttgcgtagtattccatggtgtgtatgtgccacattttcttaatccagtctatcactgatggacatttgggttggttccaagtctttgctattgtgaatagtgccgcaataaacatacgtgtgcatgtgtctttatagcagcatgatttataatcctttgggtatatacccagtaatgggatggccgggtcaaatggtatttctagttctagatccttgaggaatcgccacactgtcttccacaatggttgaactagtttacagtcccaccaacggtgtgaaagtgttcctgtttctccacatcctctccagcatctgttgtttcctgactttttaatgatcaccattctaactggagtgagatggtatctcattgtggttttgatttgcatttctctgatgaccagtgatgatgagcattttttcatgtgtctgttagctgcataaatgtcttcttttgagaagtgtctgttcctatccttggccgacttttcgatgaggttggtttttttcttgtaaatttgtttaagttctttgtagattctcgatattagccctttgtcagatgggtagattgcaaaaattttctcccattatgtaggttgcttgttcactctgatggtactttcttttgctgtgcagaagctctttcgtttaattagatcccatttgtcaattttggcttctgttgccattgcttttggtgttttcatcatgaagtccttgcccatgcctttgtcctgaatggtattgcctaggttttcttctagggttttatggttttaggtctaacatgtaagtctttaatccatcttgaattaattaatttttgtataaggtgtaaggaagggatccagtttcagctttctacatatggctagccagttttcccagcaccatttattaaatagggaatcctttccccatttcttgttttttgtcaggtttgtcaaagatcagatagttgtagatgtgtggtattatttctgaggcttccgttctgttccattggtctatatctctgttttggtaccagtaccatgctgttttggttacagtagccttagtttcctacatcttcttttagggataacagggagtattaagattcagttgttcacattgatgacttgcatgataatataccctttattggctatcttccctatttcacttcttctcaccctgttgatgtgtcctggaatcacatcccaaaactacttgagctcaaatttttatttctgggtttgctactgggagacccaaatcaagacagttggcttcagtactcaggtacttacaaggagatcatggatatcaattgaatcagaattccatgtcatagcttttcaaatttatatcacaataagttgaaaagatgttgattcttccttccacagtattttctgtttctgtgtgtcttacattctggtgtctcaaaacatggctgcaaccagggaaggaattgaaatttggagtaaatgtcctattttagtaggtctacatttaagacatggacctgaaattgagatcataaacaaaagtagatgtgagcataaagtagaaggtgaggttggagggggaaattgtttggatttactgtaaccaatggagctgcttagtctagtcaaggaatttcaatcatttctgtggagactagatgacttatgttatacaaggatatctctggaaaattcactgtacagttttactaaatctggctgataatatgttcactcaatgttatgatgtcaataatagaatggatattgcctttaaagacaattttaaagtaaatatctcacatattcctactcatttatcaagggctgtgtcattcatggcaatataagataattcttttcactttcaaaatcttccagatgcagaaactttccaatatttgctgtagatgaaagtgtacaatttcacaattcaatgggacaaaaagaattaggaaaaatatgtttcagagagtttatttggtatcatctacaagacctggtatgagacctggttggtgttgtatggaatgaaatatatcagtctgttctcacactgctaataaagacatacctgagactgggtaatttataaaggaaagtgatttaattgactcacagttcagcatggctggggaggcctcaggaaacttacaatcatggcagatggggaagcaaacaccttcttcttcacatggcagcaggaaggaggagaatgagcaaaagagggaaaagccccttataaaaccatcagacctcgtgagaactcactgtcacaagaacagcatgagggtaaccgcccgccgtgattcaattatctccacctgatccctcccaggacgtgtgggggttatgggaacaacagcttaagatgagcttttggtacagacacagccaaaccatatcatagagtttcgaatctgaaaaacaaaagaagctaatttagtttcagaaagctgagatttcatgaaccatttaaaaattcactttataatttttcatgcattttgaagcctttatcctttaaatggaaatggaatagaactattattcgtcatttctaaactgtgcattcatcaacaattttcagaagttaattccaacatgtcttcatcaactctatattacatgttagtacactacatctctattttcatgctataattttttactttttcctcacactttcatctcaccctctcaagatgtgttaatcccctttgctcttttccccatctcgtctctgttgcctttctccccccttcctttttttttaatttctgttctcttttacctgaaatctccctcttcatcttttgctaccaattatgttcttaattggttgaagtgagcaaggtaggaaattctccattttgattccattctctcacatggtttatctttaatatgttttaataaacagtttaacataaatcttacttccaatttaacatgtaaaatttagaaaattggtgaaaaatatgcctgctttttcacccccaaagaaccaagtttaaaaagttttgtgactttgaggcatccttttccctaaaagcaagcttaacagattcttagcattcgtctctgtgtgaaattgtggaaactttaaaaaaactatttgaagtaccaacaactcaaagataaattgtctgttttaaatgcaaggtgctaaaataaaactagaagattgacaatattattcatctttatcactgttctacttaaaatttgaaaattaatgttagaaatgtgagagggtgcatgaaaccttaatggttttatcatttcatctgagtatatatttgatttcttctttctgacattgaaactttaaaattcgccactatttttcagtaactcgttaaaatatggtccgttcttatatttgcaatactcctatactgaaaaccctacaacttcaccattatttaatttttatgttactatatttgtttcttaaaaagattataatattatgtattagttgtctattgctgcataacaattactacaaagataggggcttaaaactgtatctttagagtatcaggatacatatgggtcagaagtctaggcatagattatccatattctttgcttcggggtctctcacaaaggctgcacactaggtgttggccagggctagggtctcatttgaaagcttgccttggaaggacctgcttccaaactcacctgttgttggtaagtttcagttccatgtgggttattggactgtagtcttccttttcttgttggctgatggccacgtttagttccttcggtctctaacatggcaatttgcctcatcaaaatcagtgagagaaagtgggggaggggggaaagagacagagaaagagtgaaattgctagcaagacaaaagtcccaatcttatgtagcctaattggagaagtgatatccttttgtctttgacatattctgcttgtcagaagcaagtcaaaagtcttgaccactctcaaggggaggaaattattaaaggactcaaatactaggagacagagatcactgagtgccattttagagtcttcccaccacggattatttcccttcacctgctggcatttgaaaatgcagctaatactctgggattctccaaacctaatttttttgtataattagagaagtatttgtcataatctgttaagtgtagtaatatattaagaaattgaatttattccttcatatttcaaaaagtacatggggttgggggacagctatgttgtcataaactttaatacatacatgattggaatggattatgaaatatttttctctaagagatagtataaggctgcaaccactgaggctcccaaatacagatgattcatatgtatttagttttaatgcaaagcttctcatgctgatttaaactctcatattttcatatatggtgttttattttttatataatgaatgtctataaaattcctattattttttcaaaagtattgtggcaaatatttcctagtaaaatctaaagatatctttgacgtaatttttatgctctcatttatgttaagaactcaatattgaagtaatgttctttcttatttcctagtaactaaaatccttactatattcatgaagagctgtgcctctattaaaaagcttttattgcaaacagaaatgtcaaaatacagcaaaggtagagctatgtatgattcttcatctgtaatgtaattttaagtatacattttattgcataagcagagatttatacccacatttgctttcagtattcacagaagaattttcatatgtatttcttaaaataacaaaatggctgctttggtgtggggatagtatggtacagcatttattgtgaaaatgattcttatcttccatctttttcaaatggtgagttcagtatgtttaacattgctggttttataatattgcgaatatttttgagaggaagaaacaataagagactgataagaataattcatatttgctcaaagtttaatcagttttttatttgaacaaaaacttggacgaaatgtccaactttcctttgagatcagtgctctccaatgtggtaacaacagcctaccatatgagcatttgaaatatggctagtccccactgaaatgtgctgtaagtataaaacactcaccaaattacaaaacctaagtatgaaaaaaataaaatatctcattggtactttttatattgagtacaggttgaagtgacaacaatttggctatttaagttaaagaaaatataacattaaaattaatttgacctgttttttacttttgtaatgtgtagaaaattttaaattacatgtatcgctctcattataattttattggatgtcattgttctagataaacaatggcaatgttgagaggtgtcataatagggacaattgtctctgtgaagaagaaattatatgaaccctacaacatgtattagccgcagagttgcttagaattgacttactctgtcttgttgaaaataggttttcccttaaaatctctgcctgatgtagccaaccacgattcaatgagcaaacaaaaatcttaaaggggaaaaaatcattttttgagtctattttacacacccagtatcaaaaagaaaaatataaatccacaactaggattatacgggatgtaattcttggatttcttttggtcttataatgctttatacctaggagatgttcaacaaattattattgaatgattgtagtttaaccgtcagttacattttgcagcaatacatttattagtagcaaaatctgagtgtttactaattttcatcacctaatcagcaaattagtactgctcttatatcgctttgcctacgctctactcactggttcaatcagctaattttttcagaattttatggtttataaaccactatatgttgcacagtatttcctatacattagctcatttgagtcacagaagttataggaggtggatcttgtctttctttgttcagaaagagaaatccaggttcagcgaggttaactggccttgtttaagatcagcacgttgctaggtgacagaaggtgttcacttctcactgaactttgcatatcaaaagagatttaaagaattcactttggagagcgggagttatggggtgaatattttatcatgttgtccgtcttaataatcaccaatttgatactaaggctgctagtcatctctaacgaagagaagttactttgaagttggttgattgattgttgttgattgacagaagtattagttttcagaatgaactaattcattaaagaaataaaacattgggtttgttcattccataaataattgaacatttattatgtgtatgataccagcctaagcagatacctaaaaggaatggagattactatagttaataacaatgcattgtattcttgaaaattgccaagagattacattttaaacattctcaccataaaaaaatgataagaatgtggggtaatgcatatgttaattatctcaatttagccattccacagtgtatgcatatttcaaaacatgttgtacacaataaatacatacaatgttatgtgttaatttaaaaataaatacattagaaacggtaaaagtcactaggatcatggaaataaaaatgtttacatttatgtaaatattagtaatataatagagggcatatccaaaatatagtgtcatattaataagatgttgtatgattattatagactacaaaataataaaggaatagacagaatgtttctaaataaagaatagaaattacagtgaagcggaagagagagtaaccctaaacccttcataatcctccctttgcctcgtagtatagcttggaaagtaattatgtggaaagttgagattgcaacaaaggacggtagtacaggagttgcccaaggacagacaattattttctcaaataaactatagcagaagcaaaatggccttggaccacaaaagaaggccctcatgtagacattgttctattctgaagtagaatttgcagtactcaagagaagaggaaagattattataggtggagagactgtaaacaaaatattatggtaggattcctcctgaatagagcaaggtgattgtgtttgacattgaaaaggtatgtttgggcaagagtttgaaaacctttagccaccatgctaagagatcttaaatctttatctctgagtaagggcggtggttgtggttaatgatccttgagcacaactctgtcccattaaagacagtagattcaactgcttctagcattagtccatatcagggagtaaagtgatccgatacattattttcccccagtaaatggttcataaaggaaggccttggctctgccttgtatgtctacatgggagaatataccagaatgtctagaggagcatgggtagcgtaacctttccccatatgcacatacaacaaatactgataatccactcacaggggagggactcatttttaagaattaagttttattttagaagactcagtctgatggcaatgcaggggttgaattacagcaggtagagactggaggtctacaaactggtttgagatatatattttttccggtggcccagataataaggacttgaacagacttcttgctctgggaatgtaaaaggccaggctggatgtaagaggttaggaagttccaaactgtcccacattttcctttcttctgagccctccaaactgtaccagactctgcatgttacgcacttccaaagtcgcttccacattttcgggtgtcttttcagcagtgccccactctactggtaccaaattactgtattagtccattttcacactgcggataaagacatacccgagactgggcaatttacaaaagaaagaggtttaatggacttacggttccacttggctggggagacctcacaactatggcaccaggcaaggaggaacgagtcacatcttacgtggatgggcagcagtcaaagagagagcttttggagggaaactccgcttttcaaaaccatcagatctcatgagacttattcacaatcactagaacagcacaggaaagacctgcccccatgattaaattacctcccactgggtccctcccataacacatgggaattcaacatgagatttgggtggagacacagccaaaccgtatcagtgatgcaaaataaaagaagactgtggagtaaattacacatggagaaaaggaagaggaactaggaagtatagatactgtgagaattaactctctgttctacaaaagaagaaatgggcttaaagtggttccccccaaaactaaaatccaaaggcacataagtcataatgcacactgttacaccgagtccttccagctcttaacttacttgttttactgcactacacttgacttgagttttagacttagtaaatctgaggtaaatgcagattgagaatgagaacaaaatgttaaaaagagaagcagtctcattttcttactactaataggcattgcagtttgtgtgggctctagcagggatgtttgtaccactgggatctaagcatctatttctatattataaatagaaaaattaggttgagctatcgcgactccattacaaacttatggaattagattctctggtatggagcttggatatacatattaaaacaaaataaaacaaaaactcctacccaattgattctgctgtgtgctctagttaagactgttatggttaagaaaataaataatcgctgtatggaatgtatatcgtcctattttaaattaataaaaaaaattttgcaggccttcccaccttccaactcctagagacaacaaatccagatttgaaaatcagtcatattaaatagttgtatcgatatttaccctttgtttctacgttattattttcttcaattttcacacgtatttgttcatcagttggttatgatggacttcactttttttcagtcttacgaatgagatttctccctccaaaaatcaataggcacctgctgattttatttattccaacatgaagttgcagaaaatgaatatggccaaaaatggttaaaaaaaaaaaagcctgttcttcaaaagactagatcgtcagttgaagcagaaaattatattcagtgcactggatttatgcattgttttagccttctccaaccaatttagaaatgcattttcttataaaattgagattattacaaatcctgtgctaagcagctgaaataatgtgcctatgccaaggtcatatcttaaaagtttggaggagcacactgcaattgaatataagtttataaatgtattccacatacttttctgatatattttaataatttaatttttacattttacctatattgtcttcattttcactttacctttggtggtgtttcatacatattcattgtttggaagaaattaagcagacagtattctaaagtcaatactgagtctgctaatgaaaatggttaagttaattaactaaatggcaaccttcactgaacttattcaaagctatttcccctcatgatgtgttttcctgaagaaatgatgcataaaaactaaacccctgttattcgctattcttctgtatcagcctctaaattgtcactttacatgttacaacctgttgcatgatgattaattatgacaatttaatggcatgtaaagggtaaaaccctaaaggattactcaaaccatcattccttaagaaaagaaattgtaatgcctaggttatcttctagggtttttatggttttaggtctaacgtttaagtctttaatccatcttgaattgatttttgtataaggtgtaaggaagggatccagtttcagctttctacgtatggctagccaattttcccagcaccgtttattaaatagggaatcctttccccattgcttgtttttctcaggtttgtcaaagatcagatagttgtagatatgcggcgttacttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacatcccttgtaagttggattcctaggcattttattctcttgaggcattaccattcaggacataggcatgggcaaggacttcatgtctaaaacaccaaaaccaatggcaacaaaagccaaaattgacaaatgggatctaattaaactaaggagcttctgcacagcaaaagaaactaccatcagagtgaacaggcaacctacaaaatgggagaaaattttcgcaacctactcatctgataaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggactataaatcatgctgctataaagacacatgcacacgtatgtttattgcggcgctattcacaatagcaaagacttggaaccaacccaaatgtccaacaatgatagactggattaagaaaatgtggcacatatacaccatgcaatactatgcagccataaaaaaggatgagttcatgtcctttgtaggcacatgggtgaaattggaaatcatcgttctcagtaaactgtcgcaagaacaaaaaaccaaacaccgcatgttctcactcataggtgggaattgaacaatgagaacacatggacacaggaaggggaacatcacactctggggactgttgtggggtgggggaaggggggagggatagcattgggagatatacccaatgctagatgacaagttagtgggtgcagcgcgccagcatggcacatgtatacatatgtaactaacctgcacaatgtgcacatgtaccctaaaacttaaagtacaataataaaagaaaaaaaaaagaaaaaagcaaagaaattgtaaaatgttgttctatcagaaactcggctaattatttttaaattttagatcaaaaactcaactagttttaatgtactacttataagtcagataaaatcattttttatttttgttttctttttgtttttacatctgttagaaacgatggggtcttcaaagtaaaagaagagatttgcaatgcctataccaaattagttattttaggatactgaatgaaatggttttctatactcaataaaggtaaaagaataagcagaggtagatctggttttctgaaacttgaagcacattctaatttggcagttttctttaagtcaaagaatataacaggacaaatataaaattaggtatgaacatgattatagaaagaaaggaaatcataacaaattatacgtttttaaaaagatgacagataaccacatacatcacaaaaattgaaaaaaataagcagaatgttttcttaataatgaaccatctctgcaatactagaatatacagtgtctgaaataattttttctatctttctggatgcatcctctttcagcacctcttcatgtgagagcatcagaaaataatttactctttcccccagcattgttgattaaaatttgacttctatcattgatagtttagaaaagtttattttacattttcaacttattattggtgatgtcacataaattattacaatttattgtccaatttaggaagaccctgccaagtttctttcacatatgaactgtaaaatttaaaagatcattcaagttatcttgtacaataactaatacatatttttcttttagtcatactaaaccctgatgctaaggatcacccaaactttttcagggaaagaagtagcttgcaaataaatcaaggaccatttatccttactttttggaagaaatggaaaaggataaagtgttagtttaaatacactcaagaacagaatgtaagacaagaaattggaagcagagaagttcatcctcaaatgtaagagtgaaagaatagggttaatgaaacaggaaaggggaaatccaagaaaaattatgccgcgctttagagaatctcctaagcacagagatattggcaatgtgcagatgaaatagctgtcacaggtcagccatgtcagaggtgattccagccactaagtatctactgcagattagatatttggaaagcagaatgagctctgttcatgccattactggggcttgacttcttaatggtttcaagtccccctttgactctaatccttctaaagtcaactttgtataaactcttttcaaaagtgtttatccctgtagaataagttcaaaactccatgtcatggcacacaaaactcttcaaatcatattcagctggtattgttttcttccacattccagtcataactaggatcccaagaattagcaaataaaaatatgaaacatccagaattctaagcataactatgtcccaaatactacaacaaaaaatactgaaaagtatcgattgcttatacaaaatgtaaatggtatcctgtattttataaggcaaccctagtcataagatctctttcttcttcctcacacactgtcaagcttgagccaacagagtaccttttaatgggctgcgcagaatagctttcgatagtttacccattaattaacagaaaattcaaatgagatatcctctgtgaaatcatccttctctcctgcctcctgtctctccattctttctccaggagacagaggccctccagactccatgactttgtagtgtattgtgtctgtctttattagagtattcatcacttggtaattgaattctgtgtttaaatacattttttttcttccagaataagtgttcatagaagggagggatgatttacctagcatactgcctggcatataaaaggccctaaataatttttcttttaaccagtaaccaactaaccaattcaacagttttttaaatgagtgaaaccactttttaaatttttttttaaattcatgcttcacctgtaaaaatatatagatgaattgcaatctggaactctgagtaatttatataaaagtgatgaaaaagaccatggcttcagatttgttgttttaattccagcttcagttcatacaaacattacaaagtcgcagtatctactgtgtaaaaagtttcatcccaatgaagaaattaaaatgtctgtctaatagagatgctctaatggacagcgatgtgtagacttcagaagaatctcctcacacagccttggaggcataagttgggaacagagcaagttctgtgtttgcctttcaaaggaatgttcctttccctttcattgacaaatattataaagatgccccaaaacttctgtgagtttcccccgggacgtaaggtcctctgcattttcctaacttgtttctcaaagcggtggttcccaaggcctgagaatagctgtgtctcagctctctcctggaaaccagagcctaaaatgttgccacatcatcgggaatgtagctgcatacttagccagagccaagagatgagccccactcgcaaagcccatgggctggacaaaattgttagccatttggtgtaggtcattgcactaggtccattacacaggttatctggcaggagtcccggctttggaggaaagacgtttaaatcctgtaaataaatggctggaacaccatggcagttgattgtgttaagccctcatccaaaattgctttgttaggttctattctattgctcattatcttgctgtgaagaaaattaagcttacatctgcttagggtgacagggtatcctgttgtcacaggattttccacattttaggcctatgtcacaagctcccaataaaccctcagagaagatcttttgtgttcacaggcatccaggtgtcaggcagacacagtctttgtcttcttgaagctcagtgacacgttcagggctgtgtatactcctccattccctgccagagacaaaatgtttgtggaacagtcaagctagaagggacctcagaattaatctgatcaaatgtctgcatttttcagttccaaggatactcagggaaggccctcggattctataagtagcggtagaggtggtattagaagtcaggttgcctgacttccaaacctctgttagttactgtcccttcccctgcatgcagcactagtgtaatccctcaactctcacttccctttttcgccacatgcctctctctctttccttcccttgattaccctgcctatccctcctacaagggaaactaccaccaggcatcctcatctgagacccgggaatggaggccaggtcttttccctccctccctccctttcccctttttttgtgtgacagtaacattattcaagtacagctcttccttttttcagtaccttccccctcagaccagaagttaatgaaaaatagggttgcgtgatatgcagcctgggggccaaaaatgtaggacaagcagtgtgcttcagacaaaactgtagggttctggtttcatgcacaaccttggaggacggtggctagaggccctagtatgagagatcaattaaacatggaggccagaaattaaccacatgggattaacatacgtaaggttgcttcttttcaatgagtctaggaaacacactggggacaccttgttcaagacaagctactatttgatgctccttcatacgcttgcttaaaatatttgttcagcatttatttagtgggggcaagaaaaattgatgttatgttaataagaaaacctctttacctcttaccttttattaaaataatcaacttagaagatatactaaaactcacatgacttttgacatctatggatgatctttcatttaatatttttctgctattcctactatagaataaaagctgctattgcattattacagagcgtaatgtgagccacatatgttattttaatcttaatggccacattaaaatagtaaaaataaacaggtgaaatttatttggattatatgttttatttaacccagtgtatctaaaattgtatcattttgacgttgcaatcagtgcaaaaatacagtcatgctatgtgtaatgaggttttggtccatgataaactatatatacactggtgatctaataggattataatacagtaggtttaccatacctttttctatgtttaggtatgtttagatgcacgagtacttgccactatgttagaatttcctgtagtattcagtacagtcacgtgctgcacaaatttgcagcccaggagcattaggctatatcatgtagcctaggtgtgtagtaggctatatgtaccacctaggtttgtgtaggtacacactatgatgtttgcataaggataaaatcacctaatgacacatctctcagaatgtattcctgtcattaagtgatgcatggatgaattaaaatattttggattctttttttttttcagtactatgccttcggaatccaatatgtattttacagcatatgtctattccaaataggcatattctgggctgggtgctcaatagctacatgtggttagtggctaccatattaaccggtgaagttctatgcccatcaaggctacacgtaatttacagggtataatagtattttaaaaattaatttttttctggcttttatgttgacatatcgtttccattttttaaatttttgttttattttctttcactgctttggaaacgcacaacttcttggaatgcaaattaaaagatatcaaataatgatgtagataatttgttattgctaaatgtctaccacttgaaatattcaagtttcaaatttcagctaactgcgattgcaagcttcagctagctggtcccagatggatggcccagctaaatcagacatttgtacatactggctacaaagtgtcccaaaaacagaccaggagggtcgtggatttaaaaaaatttccaccaaaggatgctgtcttgtccattttccaatttgggtaaattaatggatactgcatttaaaagtttttttatttctcgtacattgaagccctgtactgcactcaccaactcacccgttaaagcggctctgaaatacaggcaggaccaagacttagatggactggaggttgggccacaactccttgaacacctagagcagaggtcagcaaactttctataacggtccagatggtaaatgttttaggctttgcaggccaataggtctctgccacgactacttaacaccgctattgtggatcaaaagcagccctaatacgtaactacacataaacgaatgggcatggctgtgtcccgtgacaatttacttggggacacaaatttgaatttcatataatattcatgtctcacccatttattaattattttcagtttcttcaaatgttaaaacaattgttagttctcaaactgtacaaagacatatggtggctgaatgtgacccataagccatagtttgctgccctctgcccaagtctcctgttgaaatggggttatggcaacaatcctcgcagaatataaaactattttggcacctgacttttgccctgatttttttattgtttccagagaaatcaagtatttttctttttcaaatttatatccatattctctttttttctttgctctcttctcttctggccagcaggaagagaccaacccatctttgaattgtattcactttcctcataccgtcacacagctagtaaagctacaacttcacatatgccaatgccaactcttcccgatgttgtgttcaaaacctttctaagcatcaccattcccaggagtagcaattctatatgatattattattttacttgttggtaaggttaaaagttccagggatactgattttcttctttgttagccatgtttcattgagtggataagcaatatgcatttgcttcatagtataaataacaataatgcatcaaattgcaacaatatgaatattacacatagaaaagataaatgtgagttatgtaggtcatgccatttgatagaaaattttttttatatttatatgtttaaacatgacaataaaatgattccattcagatgaaggcaaaggaataggatttcttttcagtgtggtggttttctatttttgttttgttttgttttgttttttagagaatgagttttggagaaaaacaagctttctagacagaaaatattgaaattaaaaccagcaattcatggtcatattattgaaactatcaaattggtatatatatttgaacactactgattattttctaaaatgttacgctttcaaaaaatcatgaagattggcaagttttttagatgcataagcaaatagtgtagtacggcttgtaacactgttcaagataacttttttataatgagtatggtctttctctgccctgtctaatacaatgtgggttttgagcattggaaatgtggtaagtgcaactaaggaactgatatttaaattgtatttaagtttaatacatttaaatttaaagttacattttgataaattgctttgtttttcttttttctttctttctttcttcttctttttttttttgttttgttttttttgaaacaacaatctcactatgttgcctcccaggctggtatccaactcctgggctcaagcagtcctccttcctcggcctcccaaagtgctaggattataggcaggcaccaccatccccagctaaattgtttcttaaatgaaacttctgaatttgaggatacgtgattatgtggtgtagttttccctttctttccccccctgaaatccatattctgaagtacagtgatttatataaaagtaaaaagaaggagactgttttttttttttaaattctattaagaaaccaaattttaacagacacctcagggcctaaataaatatcaagttattgttatttgttatggttcttgttgcttgggtaaaactgtacagatcatgacttagttttccttgaatttttatcaaacaaatgaacaaaatgagcaaacaaaaatattaaaaatgatatttcctacgaatccaagggacatttttctgtatcagccaggctgatgctaaggtccttcaagcaaataagatcaaagatttctgattggagagtgtgggaataaagtagcccttgtttagtgctactttgtagagcctttgtttagagtacggctgggagggagggagagagggagaaaaatacggggttaatttgtaacaacacattctgtggtgtgcgtgtgtgtgtgtgtgtgtgtgtgtgtgtgtgtgtgagagagagagagagagagagagagagacagagagagagattaaattacatttaacttctttaaattttattgtcctcagggtttaaacagtatgtgaccaaaatcacattatttagtgaagagtttgtgggtaggtggatagttagatgggtataaatccctataaaatccattttagaactattgaggtttgagcaaatcaatgtcacctattcacttcatttgtctaatgcctccaggagccattaaagggcttgttacctaactttagggtaggtttagatcaaggtgaacagtcagaaaatattatccatgtactcacgtatattattaagtattctttgaccatggagttagatgcttatactgcaaacaaataaattaatgaataacagtgctgctcatgaacaccaaagtttactgaaaagtcaatatggttttagtgtggtaataagggcagagttctccaaggactgccaacctatttattgtacatcaaattttactgactttgaaatcttgctagaaatgttcatttacctcgtaatgtattatatgtttgaggtcttgagaaaaataacaaaatccatgtgtggtaatgaagtggttatgcaataaaactaacatacactgtgatttgacacaggggacttcactgttatcagatacttaaaactggaaacaatgtaggaaatatagatgtataagcatcgtaagtaaaatccacatgctttaaaaaggaaatccacttacttttaaagtaatattccgagagctatgccactgggggctgaatgtcataaaaatgatttgtaattagtcacttttacattgtatatggatttatagttttaaaatatctggtggcatataaccacaatgtatttttcagtcatatattcatcattattttattaaatttccagagggaaagaaaataaatgacctcctagtgagggatattttaccacgagaccagttgtaaaaataatcgagttttgtgcctgggaagatatctttgctaagtctagttctccagtgacattaatttattgttgttaagaaatgtgtgaggcaaaatgaactctccaaatatttcatactacgtgcattttatccaaaagaagataatggtttacatgaattatttaattggtattactaatttgggggaggtgatttttggttgggggcaacagaatatttgcctaaaatgcattcagagtgcgctgttatttagctattttcaaggtagagggatattggcattggagacttacacgtagccatacaatggccaacttcagtcaactacagaagcaatacagggcagcggctggaacaaaatagctactaggtaaatattgattgaattaattacacggatattaccactagtcctgcaattaattaatacctagccctgtctccagccccagaatccatgacatcaagctaactaacagaaaacatatcaagaattttattccttagtcctcttgactgaccctcaagagggtctaccctcttctactctgtattcctcacatcaaatttcactagtccagccgccaagtaacacctgttctgactgtgctagtgaacttggatattcacacatagcctaaaatgggaaacagagttggaaatgtcatgtataaggacataagcgttttcaaagtgtacaagaacataagcgtttttaggagatttaccttctcttttctgttttattagcgaatgattgattgttttgtatgattgttcatttaacaaatgctatatcatgtaagaaaagttactaacggtatataaagatgtaaaattcaattgtggctgtgtgtatgtgtgagtattctagcttttggggagagacaagagaagaaagaagacataagttggaagagaacagtaaaataaagaaaaaagtaataactgacggtgtctaatgaagtagcccaggtaattaatgctagagtttattagatagaatcattatttccttccagagggattaagcaatcttctctgaggaggtggaacttttattacccaaaacatgaaggattgggaagagttttatatgtgtcgataaggaaaagagatattttattgagggaaaagaagacattttaatggcagagtacacaatgtcagaggaacagaccaaaagaagtgctttgttattaggaagatttgaagaatggaagatagcgtcagattgttaagaaccattttttagataaaggcaggctaaagaagttggaggctattggaaatcagtcacacaattttaagcaagagaatcaatgagtggcagttttgaaaactgaatttgatagtggcaaggaaaatagggctctatcatcccacttactttcaaagttatgaagaaattgtagtaagctccagtcagtacctaaaggaatttattttgtgaaattgtgtaaacaaaaagcaaaccttcttttgcactcatatagtatattttctcaaagtcatatagctaaagggaatgagaggtaaaatagtacagtggttaacaggataggcttcaaagcctaacttcttgggttcaaatcctagcttggttaccatttcacagctatctgaccttgtacaagtcacatgcgtacactgggaacaataatactacctgtattatagagttgttattagatgttgttgatagatatgttgggcacattttaggcactacatacataaacctctttctatagaagtatacatgtgtacctatatttaaaataatgattttcttttttaaaagaagcacatattcattgcagaaaatttttttgaaattttaaaagtaaaatctctggtctaagtgcactaaaatgttttagactttagatatgaactacaaaaacctacctcatcgacacccaaccccactcccagagatatttcattttatttgcttgctatcagtaatgagaagacccaattcaccacacaatttctgttgtatgagactattgtattgcagtgcaagatagtgttttaaatctttgttaaatcaataggtgcaatattacacctccctgtttgaattttcctagtgaagtcaaacaattttaataggcctatacataggtcagttatagttctttcctaaatggtctattcctcattatcctttttaattgagtatttgtctttttttctactgatttgtgagaatgtttttatcttaagagtgtcaaaaagatgaattgtttttgcctttttctttggcttgtttgattttttatgtaaagaaattttatactgctatgaatgtaagtcattactttatggcttttaaattaaaattataagaatagcctcccatattttcattacttttatagttcaatttttttacatgtaacatttcattcatctggtatttagttaggaattgtgtgagataggattttaaaattaagttaaaattcaatcaagtctttattttttaagtacagaagtttccgaattcagcatttacattaaattttttgaaaataatgctaaaatatcatgtaaattattacttattggaattgaaaattccctattattatttttaatctttataacaacttatgttatctatgcttctattataaaataaatgacaagccaaccaaaatagagaagatgcttatcacaattatatcatgataatttaaacatgattttggattaatcataatccaaaaatgcatttgataagcattctaactgttcttctagtccccataaaattaacaaatggcaaacagtaatgttttaattttcaaaatattcatattaatattcattttcaaaatatgtttacttgcatgcatttcatttatattatttcttattgaagttgacttctcaatgtatattgctttaatgatactaagtattaagggtatagattgtactcacacaaataactattgaaaagcataagtttaaatagatccatttatcaaatgatgtctttttttttcttttttttttttttttttttttttttgtgagacggagtctcgctctgtcgcccaggcaggagtgcagtggcgcgatctcggctcactgcaaactccacctcctaagttcacaccattctcctgcctcagcctccagagtagctgggactacaggtgcccaccaccatgcccggctaattttttgtatttttagtagagacggggtttcaccgtgttagccaggatggtctcgatctcctgaccttatgatccgcccgcctcggcctccccaaagtgctgggattacaggcgtgagccaccgcgcccggcccagatgatgtcaattttgaaagatactggaaagtatgttttgggagggaagagggaaggaaagagtagaatatgaagtcagtaaaacctggatatttagtgccatctttgttacttactagtaaccttatgaatattatttatattgttgatccttaatatcctcacttgataattttagaaaatgttatgtacttcataggatcatgggtagaataagaaagtgaatataagtaaaatccatcatgaagtacctgaaatatgttgtaaacctaagttataatagtaattttattgttgctaatatttcagaggaatagccaccaaaccagtactacttattatttatttctatttaacatataaaacatataatattctttctgagtggtaactttgaaaagggacaaaaatattaaaaattacattaaaatcatgtataatttataatactcctttcaaggttactaaagtgtgcatgtatttctaatcattcacaaatatgaaaatctatgtgtaaatttttaaattttctaaaaaattgacaaataaaaattgtattattgtcatggtgtacaatgtgatattgtgaaatatcacatattgtgaaataaacattgcggaatgactaaatcaagctatagaacatattcattaccttacatacttattattttttgtggtaagaacacttaaaatctacttttagtaatttccaagtatacgttattgttactaacagtagtcaccctgagttacaacagataactaggatttattcctcctgtcaaactgaaattgtgtatcttttcatcaatatctcccaaatcaccccacccccaggatctaataaccaccatttttctctgtttctctgagtttgacatttttagatttcacatataagtgaaatcatacagtatttgcctttctttgcctagcttatttcacttgacatcatgtcttccagttcaatccgtgttgttgcaaatgacaggatttctttctttcctaaggctgaatagagttccattgtgtttatataccgcaatttctttaaccgttcatttattgatggacatttaggttgattccatatcttggctattgcaaatagtgccgcagtaaacatgagagggcagatatctcttcaaaatactgatttcagttcttttggatatatgcccagagataagattgctaaatcatatggtagttctatttttaatgttttgtggatcttccatactgttttccacaataattatactaatttacattcccatcaacattgtacaagggttctcttttctccacattctggccaacacttttcttttgtctttttgataatagtcattctaacaggtataagatgatatcttattttggctttgatttgcatttccctgctgattagtgaggttgatcatttttttttttcatatgcttgttagccatttgtatgtttgctttagagaaatatctattcatgtcctttgctgtgtgtcgatactgatatgtaaaatatgcatacaaaatcaaaaccataatttatttttaatatatttttaatatgtcattaatatttttcagtgtaataggatgtttttcataatatttactttaatggacgcaacatatttcattatgtaaaagcagtttattctatttggggagatttcgtttcactttttcgccagagtgacataattgaacattcttgtcataggtctctgtgtttatctctgatattcccctaggaaaattcatagaagtagcattttggagttgaagggaatgagtaatcttaaggcttttaaagtagttttatcaaattttctaaactgaagtataaagacacatagaaaagtacacaaatcataagaatagaaattcagggatttttaaaaaaaacttagtgtatccatgctactaccaccaagttcaagaattagaacattacctcaggagcccctctcatgttccctcccagttatgagcctctcccctgccaccaccctctcccaaagataagcactcttttgacttctaacacctagattagttttgactttgaaattactataaacagaatcatccagtatatgcccttgtatttgacatgtcctgctcaacattatttttgtgatattattctatgctattgcctgtgccatagttagtttagtttttctatgtatggtattctattgtgtgaatatgccacagtttatccattctgctaatcaatggacattgggctgtgtctattatggggctattaggaaaaatgctggtgtgatgttcctgtcctttgctgcatatatgtatatatttatttttaatatacgtggaagtacaatggctaggtcataagatgtgtacatttggctttggaatcaccaaaaaacagtttttcagtgtggtcatttcagttcattttcaccagcagtatataagacttctagttgatccacatattcatcaagagtatgtattttcaacctttatccttttaaccatttaggtgaatgtgaaatggtatttcattgtgttttaatttgcaatcacctgacgattagtgccatttttatatcctcttatgtgaagtcattatgcaaatcttttgcccattaaaaataatagttgtctttttcttactgatgtagaagttatttggatacaagtcctttgtcagatctatgcattgcgaatatctttttccaacctaaactttgctttatttttttctcttaacaatctttcctgataaatggagtttgatttatcagtcttttcctttatggctaatgctttttatgtcttgtttaaaaaataatacattaacctaaaattgttgagatttttttctatattttcttttgaaaactttatttttttgccttttacattgaggtctgcaaacaatctagaatttatgttttgtgtatgatgtggagagtcaaggttcatgtttttcaaatgactaatcagttaacttggtgctatttactgaaaagatcatccttttccaacttaagtgacaccatcgtataaattaggaaacgctatatagatgatttgttctcacttcaatcccacacaggcttaattataataaatattcatgtctggtggcaaacattcttaaacttcgtcgttcttcaaagttgccttggatattcttagccctttgcacttacatataaatcttaggattggcatgtcaatttctactaagaaatggttgctgcaattttgattgagattgcattgaatttatagattatttgaagagagggcagatatctttacagtattggactttctaattcatgaagaaggtagtcctctatttgtttacattttcttcactgtctcagtagtgtttgtagtttccagggtagaagcttaacttttcggtctgaattaccaaattactagcaacatatatagtcatgcatttcttaacaaatgagatatgttctgaaaaatgtgtcattaggtgattttgttgttgtataatcatagagtgtacttacacaaagatagatggtatagcctactgcacatccaggctatatggtacagcatattgctcctaggctacaaacctgtactgcatgtgactttactgaatactgtagtcaattgtcacacaacaatatttgtgtatctagacacagaaaatgtaccgtaaaaatacagtatacaaatgataaaaaatagtacagctgcatacggtatttaccatgaatggagcttgcaggactcaaagttgctctgggtgagtcggtgagtgagtggtagtggtgagcaaatgtgaaatctaagacattattgtacggtaccatacagtttacaaacactgtatagttaggctgcactaaatttatgaggacacatttttatcttttttttttttttttgtatttttagtagagatggggtttcaccgtgttagccaggatggtcccgatctcctgaccttgtgatccacccgcctcggcctcccaaagtgctgggattacaggcgtgagccaccgcgcctggcccatttattttcattaatgataagttaaccttagcttatagtaacttttttactttataaactttttttttaagtttttgactctgtaataacacttagcttaaaacatgaacacgttgaacacccgtacaaaaatattttatatccttattgtagcagctttcttatttttaatatttttgctgtttaagcttttctgttaaaaagtaaaacacaaacacgcacatgagcctaggcctacatgggtcaggatcatcaatatcactgtcttccacttccacatgctgtcccccactggaaggtcttcatgggcaatgaaacattcatgaaactatcatctcataggataacaatgccttcttttgaactaattaagaatatagtaaatacataaaccaataacagttgtttattatcattatcaagtattgcatactgtacatacttgtctgtgctgtatttttatataactggcagtgcagtaggtttgcttacaccagcatcaccacaaacgtgagagtaattcattgcactgtgacatcactaggtaataggaatttttcagctccattgtaatctcataggatcacagtcagtctgttgactgaaatgtggtgaatgactgtataatagggctccaaggaagatcataaaattgcttgttttccagaactttgacaaagaccttttacagaaactaatataatagataaataatagtataacattgctgttttcctttgcatttcattgattactaactgtctggattttttcttgtttattggctgtttacatttttgtcaatttctttttatgttctttatccagttttccagtagatttttcctttttttactcattaaaagatttttttatatgctaaaattattaccctgtgtctgatatatgctgcaaatattcccagttgtcatttgttttaattttgattagtggctttaatttataagtgaatacgcatattatattcaatctttttatattctttttttgcttctaaaaggcttccccacgccaatattttattccagttcttcttactatttttatgcttaacactttaatttttctaaaatgttttgtgttatgaaatccatcttaatatgtttatttctaaaacagacacttttgcttatcttaatattaaaacatatacatttgaaattaacattcagagattgaaagaataaggaaagtaatcttgtgtgaaattaggtcaagatgtgcttagatactaaattaacacataagggaattgaatgtgtttgttttctttcaccacagggaacatgttatatgaagagcatggttttataatacataaaaggattattagaaaaatgatgtattttaccggtcaggtgtttgtgtctatactttgatgtgaatgcaaaatagtaaatataaatgtaaattaatttaaaacacatagaatctgatacaaaccttaatctttttccacgttatacattactcacacctgttatatttttccgtgaagtatttggaatactctcgattcctggaaactgttttaaagtgcagaagagcacaaaaaaaatatgtgttaaaagttcttgatttccacccaaccattaagtgatattgccaaagaaaactcttcagagcatttttcactgatggctttagatatgttataccagaataataatgattcattattaaaatatgcaaagtgtaatttctcaacaacattttgtggtaggaagatgagctggtacagtagttttccttattaaataattttttacaaaagtaattgacatggtttggctgtgtccccacccaaatctcaccttgaattatggtaatccccacatgtcaagggtggagccaggtgcagataattgaatcatggaagaggatcccccatactgttctcctgataatcagtaagtttcacaagatctgatagttttataaatgtgagttcccctgagcaagctctcttccctgctgccatgtagaatgtgtttttgcttctcctttgccttctgccatgattgtgaggcccccccccgccatgtagaatggtgagtccattaaacctctttcctttataaatcacccagtctcagatatgtctttgttaacagtgtgagagcagactaatacagtaatgcatttacattgttcaaaatataaaaggtacagtaaaaaatatctcaccctacccatcatctgctctaccctcactgcacattaaccttaattctagaaacaaatctacaaaataaattcctgggaataaaatttccaggtcaaagtttacatgctttttatagatatggccaaactgccttccacaagaggtacacaaatgtatacttcccaccagccacgtagaagagtctgcattttcccacagccttggcagcatagtgtacctgcagacttgaatttttgccagtgcaatagatgaagctctaattttcatttctctcattattaccaaggctaagcttctgttcatgcttttaaaatcctttgtattttcttttctgtgaactgtccttatcttttgtccaattttcttttgggttgttggcctttttcttattactttgcagaaggtctttcatgtgttaggaaaattagtcccttagacatgagtcacaagcatttatttttcataattgttcatttgtttttgattttgcctatggctcttttggtcgtgcagaagcttttgattttttatatagtccagtttactgatatttttgtctgttaattaaagttatttaacttgaggatacaatttacatttttttgtggttgactactatagacatatactgcttcttacattgaaaaaataataatcctgaatttggaaattgtttttaacaaacttttggtgaaggtccatcatatttaggaacagagcttgtttgacccagaaatcaaaggtcagtgagaaggagcaatgtaaatagaaagttaaatagcatgaggtaaatgttatgatggtgggaaagacaagatctgagaggataaacctaaagcaacatcataattaagctgaaaatttcgtctcatgataagctatcatttcattattccagatattagtcaaatctgacccattacactgttttctgtcaggaattgttttacctctattacaaggaagggatagtatgggaggatgataaggaaaccagcagtcttagttaaatgttatacagatttctgtgcttatatatgaagcctaaatgaaacgtgaacaatttcatgatcagataaaaaggagttcatcgctcagttttagagattttaggaaaatatgatggctattatctcagtagcttcagagtctagaggcatttagatgttgttagttgaagctgtaaaacgctttttacatctacttgtgagtagaaaatgatccaataaaaataaaatgtttagttacctcctttaaaatgcttgaaaaataagttgaggacatcattagatcatgtattacagacgtaggagtatatttgtaacatcacctacatcacacatacctgtgtgcgcgcgtgcgtgcacacacacacacacacacacacacacaagagttcagcaccacaggtgtagttatggatgtgaactcacaaaacacaaatcaagcaaagagaacaatatctcaattcatgattcatggacattctgtgctatctgaaacacaatgcttcttttgcccaactctcacccacacagggaaaggctgccaggaatgagaggcaagaagtgtgcaggtcaccttcaacaggagccaccacctgtatttcccatcagtcttttacaccattgtagtcacgtggatccaaggactgtattccaactgacagctcctgcgatgaggtgcagttccacacgacaaagccaggcccaacatttcccattcatcttaaagttagtgtttccaaggaaacagtgctgtgggagcctagggtcagtcccagactgacctgcaacagcccaggctggatgttaatcctttgcttatacagtctcatgaatttttcacaacatatatacatgcatttacaagacgtttcactgtacatattgtttacgtatacaatcttgtttaaaattcatttttctgtacattaattgatttttttctcgacaactttctctttttcatctcctaactcttgcatccaattaaacaatgtactgttcattagtgacttattttaaaagtatctaaaacaattgttccaaagcatgtgacattgtttatgtgacacactggtatattatctagtttatttttaaaatcttctctattattattcataatatattattatggaacagatgtatattataaaattttattcatattgcagtgtaatattttgtattacagtggtattgttaatagtctcgtaaagagctatcattacaagtttaaattctttattctgggatgccagttttaactcttgatattctgaagaaaatagctttactcttgtttattctggctctgtttttttgttttgttttgttttgttttttgttttttttgttttttttttgtagagatgggagtgttgctatgttgtccaggctggcctcgaactcctgggctcaagcaatcctcctgcctcagcctcccaaagtgctgggattacaggcaagagctacagtgctcagcctatcctggctctttatttacatgtaagcttgagcaataatcactgctacttaataactttattgtcattcattatcatgcagagtattgctctaaggtatgttcagggatgacgttactgagtcctaacagtaatcctatgaagcaggtgctatcattgtccccaatctacagaggaggcattgagagttagagaaaacttggctaaaatgttaggcaagaactagaaccagaattgaaatccaagtggcctaactctagacctcacaatgcttaataccatgtcatgctgcttcctaacctatttaatgtttttttcaaccccaacgtcatcacccatgtgtgatagtgggatcataataatatctatgtcgtagcattgttggatggattaaggaagtctacaaatgtgaaacttccaaggatgatggttggcatatactgatctcttaataaaaataacctataatcattctgttacagtctactctaatccaaatgttctttttacttctcatctcaaccacctgcttctgtttactaggactcacaaactatagctcacaaaaacgcataacttaccaattttccttgtacatgaagggacttccttttacaatcttccatgacataaaagaaagctagaagcaagtatagtagaagaaatgattgctatacaaacaaaattatagttggtttggttttaattttaggatgcgcattgaataaaaatcactcatttgggatttagaagacctgtgttatatatctggtgctaatgctgaataacttggcttattcatttttataactgcaaaggaagcgcgtatggcatataatacacaacacaccagtatatttagtaactgagtgaataaatgaaagatgtatttctttactttatcagttgcagttggctatgcctttgtgtaaggtgtgtgttttgaaattccaaaaaggtattagtttctttaaagcaaagaatttttgtagcaggttaatgaataattttgaatacattggttaaatcccaacatgtaatatatgtaaataatcaatattatgctgctaaaataacacaaatcagtaagattctgtaatatttcatgataaataacttttgaaaatatatttttaaacattttggcttatgccttgagaattatttacctttttaaaatgtattttcctttcaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggtagggaactttttgctttaaatatttttgtcttttttaagaaaaatggcaatatcactgaattttctcatttggtatcattattaaagacaaaatattacttgttaaagtgtggtaaggaagactttattcaggataaccacaataggcacagggaccactgcaatggagtattacaggaggttggatagagagagattgggctcaactctaaatacagcacagtggaagtaggaatttatagccaaggagcagtgtaggagtcagtagatggaaaattattaagaggaaacatcaggggtaagtgggattctggctaaaccaacctcacaggattcttgctgaagataggccagggttatcttatcagacaacccttggggaatggtggagaatactgagggtgatcaggtaccaaggataaagggttcttgtaaaactgacaggcttctttgctgaacctggattttacaggggagtgcaaagatgagcccaggcgaaggttcagaagcctgactaaagtttagtcaagcagggaatctttgtcatcatcatcattgttgtcataatgataataattattattattttactagaatatgttgctttttcctcagcatttactagaaataaggtcttcattaaacttatgttactagaatgcctgcatcatatttgttactgtgattcattttctatccctgttttaattgtgcttaatacatattcatagattccttatccaaaattgaagttgtttatgagattaggttcctaaaatataatgtctgggctcttttgtagacattgtaaagccctctcagactgactacactttacctttctatcttctcattctgccagcaatctccccgtatagtctggccacatcaaattacctggtacctttccatccatgtaatttcatgtcatacctgtgatcttggttttctctcttctttaaatgacttctttcagtttattttgatataatgaattttcttccattctttaagaatgaattcaaagtcattgcgtcttccaagttttcttccgtaccccaagtagagttagaatccctgttaggatttcttataaacctttttattcatctcccattgttcatatgttgatttacacttaaattttatacacctgagtatttcattacacatctgcactgttctttgagtgcagagggcattctcttatttatctctgcttctccactcatatcatacacactcagcctaggatccagtaaatgatgcttacttgtgagtgtttttaagtcaatgaataaagacagtaccaagacacccagaatacgaatgagatactgcaggtaagcgtaaggcttcagacaatcctgccaattgaacaccactatctccttcttctagtgtccttgtaaatgctgattgatcttcttttctccctttcaaggaatctattccaaagattctttcaatatgctgccccgttttgcgtctccttatttgccaaaatctttaagtagccaatcaaataaaccgaatcgttgaaattacaatctattaatgaatgtattgttgggcaacttcagagtaaaaaggataagtaacatttttgagtagttttttcttttatttaattgactttaattgttaaatttatttactgtccagtattgtaaaaacctaacattttaatctccatttagctgttgttttgctggaactgagagcaaagggaaaaggaagtttgagaatattctagtgaagaggaagtaaaagtttcgggaagatgggcatgagtaacaaggagatagagggaagtttgctacaactaaaatgagttagattagcaaaatgttctcgactatgtttaccttacttcctcctgacacttatgtctaccattctgatagctactcctcaagagcagatggcactgtggaagtcacaagtagacatcatttcactagcacaaaactcagcctgctcagccagtggcacagtcttgggttcagtctgatgattaaatttacgagacataataggctttacccagtaacaaatttagttagctttaagaaattatacaggatgggtaacaacagcctgcacattaaaggcacagtggaagtcttgataccaagacgtggcttctgatgtcccatcaccctgaattttagtcatacatgatcacaaggggcaagactgggtgcgtacaaaacacatcatcgtctcagggaagccatcagttctaggatcctgaccatttctccacttagctagtacatattgtactcagaggtgtttgactagctcctattcaccagtacaattacatctcatgaatactgatttttcactgctcaataaacaaccccaacaagaaagtacagttacttggcccaatacacaataaccttagccaaattctcaattatcttatatccagtatattcttaaaaagtaactggcgtaatattgcgaagaggaaaggtcataaagtctttcctcccaaccagaaatagctttttgtagctcacggtaaaagcacattctactcttttaaatgcaatctttggttaaaatgtgcctctttattataatagtttaaaaaatactcaatgctagctatctctcttcctggaacacatttaagaaaagatttttttttgaatcccttggtacaaatagatcctgtttactcaatcaaaatgacttttgtcccagtctgtgccccccggaatggttttcaaataatgaaaacctgcattgtgtcttcgattgtctatggcccatagggctctgccaaatgggtccctgcagtttgaagtgaaagccatactcggctgtgttaatcacttttctttatcaaagctacaagtcaccactcactgctgtgtgtagtttctgagagtcatgatatttgcctcctgcagcttgttttaaatcactgaggggagagggagctgcttttttcctggcagaaaactccttggcttcagtcctctgagcacattccgagtttcttatctctggagtgcagacttcaaaaatactcttttagcctttttcttctgcttgtggctgtgttcaaggtggggggaggggaaacataaaatcatagatttgatgacttgagagtttctcccaaaaattctcaaacccccagcttataattaggaaatggtgacctgtgtgaataataatttaccttgttttttatccctctttgtctagcttccattcctttcactaataaatgatttattaagattgcacagtttttctgatttaagatataggatattagtccttacagcctgctgtattcctctgcttaaaggaattaaactatttttccattaaagaaagatgggacactagactttgctttacttagtttcaaactactgaacaccaaaaataaaatttttaaggagttttgagcacatgcccttttttttaacacaaggtaaaaaaaaaaaaacacctttactaaaatcttaagaaagagttaatgcaaaggaagtagatatacgaacagccacgcccctagctccaaatcctaaatgtaaagaaacttgccttgtctggccatggtggccatagctgcctcggaaacaaagggtctgaggccttgccattcgggtagtttgttttctctagtcaaactctgagcacacctgttagaaaaatatgtaataccctctctctgtgagcctcagttttgtctgcttggtacttcactcttattgatgaaatgcagctagctgtgtagtgaaacccagataaaaaaaagctttaagggctgtgttctaatacattgtttatgctggagtgaaaattgactgcacattgcttggtttgtgcaatttactcccgaaatattcctattcaggaaatcctgcaaatagcaatattcatcttgaaaatcacctcacagaacccttagcaagctgagaaacataatcaatgagatcgtgatgtagagggtgaaaattaggcgtaatcacagccctttcccatcagtcagcccactagaaggcatgcctttgaattttgattttcaaatatactctcaatttagacataaaatatgttgatttcagatttcagaaatgataattgaatgctaagatcccgggaccagtttagaatttctataaagggtcttatgtttttaacctttaatgaatgctttcaataatgagctagaggtatactatttatctgacataagactgactactgctttccaaactttttattaaaatatgaggtgtggcgggacacataattttatgttaaggcttagtgactgaaatactttcatcttaatcacagggagggggttttttcctcccctcaagaatcactttccttctgtggtttataaataaacatgacatgtggctctgctggctcttccttgcagtataaggagcataattgcccataatgtcaaatccacactaaaaactaccaaaggactcaattgtagtgactgaccattaaagtcactgaacactgtgtgtgttcacattgctgtgagtgttgtcaaagaaaaatagcactagacaacagacaagaaagactgtgttcaaaacttttgcaatagaggagacagattgaactcaattctgctgaaataaaaggcaggagagcctctaagtgctgagatgagttagtgagaaagtactagatatcaggagggaggttagtcaatgtgcttatttaggccatctgtgtttgctgattggcacttatcaaagttagattcctatcctcccaacagaagactagcagattggggcactatcttttttgatgattctatatcaaagtgctagctcccaagtccttgagaaagtttattcctgaggtataaaagtggcaagaggctaggagaatatttttgtctcaaaaaagtagagaaataatatataaagttttctagagtaaatgctctaagaaaaggaaggtcaggtctaaagtcaggaagaaatctgtctcaaatgtagtcaaactcagggtatttttaaagctttctttgtcaaccctccattttgttcaagggaaaccagttttcccattgaaaaacttaggaacgccagttcatctagttcatttcagcaggtttctgttgttgaaggactagctgaacgaactctgacacttggtagtaatcagacatttcatgaaggagatttccatgaaagttagaaggaagacgaagattaatggttgaagcagactgcaaactcagtttttgagtccagagggcagcaagtcaaaaagattcctagaagctgggctgtaggcattctcagatggtagagtgaggatggcagtagcaatccgatggatttcttggagcatggcacggaagaggttggagtttactgaactttttgcatggcctacaaagcagcagctccaggcatgaaagttgtctatacataatttgctgtggtggtgagtcctttgtagtttatagcaagtcatccagcttctgcttgcagggcttctttagatattgtggggaaatggcagctataagacaacctagagaagagagtccttatctcagtaataatatgggcagtcacgttttagttctcagtgtcaccaagtcaggatggtgggagaaaaatttgaaatgttaatttggagaatcgcagccagattgtaaaggaaataaactgaaaattggtaaggacggacaaaatgtgtaagacagcaggatccagatcaatttacaggtaggtaaaaaaaaaaaaaaaaaaatcatgtcgtttacaaagaaatgcaaaatagatcaaagacaatgaacaggactagaatctgataaccccaagggttactgaaactctatctctaccatcacccttttgatcagtgttaatcaaagtaagactttccttgtttataaaataagactggcctatttatttatataggggtagcaaaaatggtaatttaccaaataggctattttaagtgtgattagctggaagttttcatgaagaatcacaagctgaataagtttcagagatatactgtacagcatagtgcctatagttaacgatactgtactgtacaattagaaatttgctgagggcagagtttaagtgttcttaccacaaaatactactactctcttttaggagcagtggtacataaggtgagaggaaacttttggaggtaacgcataggtttatggcatagattgtggtattggttttgtatatatactttatctccaaactcatcaagttctatgcattaaatatgtacagctttctgtttgtcaatcatacctcaataaagtagtttaaaaaatatgaaacctcagatttgattttttaaaagtctccaaagtttaggaaggcaagtcaagaacttgacatcagattttacctgaagtaaaatacctatagattcagctgaagtgttctgttttccaggttcctaaaatacccttggtttcctgggtctcctaagaatagaccttccttactcagttgtaagattgggaattctgtaagccaggtaccgggacagttttcccaaaaggggcttatattagctccatatagtcaagagtagctccttaaaactggtcacatctgactctatgcacttaattctcaaatatgacattccagtcaaagccttggttatatatttttttcaattatgtcttgttacctaaatatatttattgagcctatgcaaataattatattgccatgaaaataagaatactcggtaagaatttctgaattttacagggatcaggcagggataaaaagattaatgtttcattctgtttacaaaagcatactctaaattctcatgagttatagataacttaagagaaaaaggaaaggcgtttcttgtatttagcaaacagaacattaaaacatgaggaatattttaaacaaaagccataatcaaatcttttatcagttcattcaggcccatgtagttaattcttgtcttgcttgatcttgagttagtagtttcatgaactcatcagcttcttcacagagtttcataaatcctgactttgtccaatggtataatctcgaagttatttaagcaatggcatcagaagtctgtgtcccagagtacctgtcgtagtacttcctatgggtctcaaagatggtcctgttttactgaagatgatgcattctgacctctaactgattgtaagagcactcagggaagcatcagcataaaccaaaaactatctgtgaacgacaaaagacttaaaatggccataattaaagatctgattcattcgacaagaaattttttttttccctggtgccatgccacattttaaaataacaactggagttaggactgatgacataatattattatcggataaagtagcaccaggatgtgtcatggacacctagagcacctagagcactaacaaagttctaaggatttattataatttttcaagtatttatactaataatagttgacccatacaactataacctagtcaaggttcagcatctcttcttgtcaaagctttttatgcaactcaacataccaaatgaacctagttatttttaacatccttcattttacaagggtgcaggaacaaatcctttgaaatttttcaaaccaatctgagattaaaaaaaattttatttaagaattgacctgggaaaagcaaaatatcaaaggttgtaaaatgacaaaaggtttgaatacttggctgaataggatcattgctcactatgaaagaatgcatggctacctatgtaaccaagatgacaataaaagatttcaaaaataaatgtagaaggccacatgacggtaaaagtttttagttctttccaaagagaaaacactactttctaaaaaaattcaaggacatacaaaatcaacacaggtacttattctgataagaaacaatatttgtttcctatacagattacccaaaatataaaaaaaaaaacaaattttgcaatctcttattaagagaagaccaatagaaaagatgaaaatgttaattagtttgaccgaaataattgttttgcaattttgtgtgtgcgtatatatatatatatatatcaaaatatgttgcatacttaagtatattcaattttatttcaaaagagcagaccaataatccaagaatattttatcattttttaacaaaaagaaactacaactcatttttgatcaatacactgttgatactaagggtcatttgtaagagtttacatacacataaatccattccgttttagccagcattggctattaacataagactctccttccacaaatcttctgccatttccaatgttcattcagattttgtcctataccttcctcttcctcattttcacagtcattttaatttaggacaaagttattctctttttccttaacaaaaacacatccaacataccttgtatattttgcatacaaagttgtttccctttacccctaatgtttctggaagttttatttacatatattgattatatttttaaccattagtaagtcttattttatagagaaaactaggaattagctaagtgtgaactgtttgtcatataccagtatttcatagccaactagcaaagcttatgaatacaagttaaattcacctactcaatatgagggctaaaagtttacatcaatatttgtggaggagccttttaagattttcttttgccctgatatgtaatttatggaggctgtgttctaaaatttgagtaaatgactgaggagatacctagtggccatctgggtatctccaaatcccatctgaacgtacacggtatccagtctgtttccaattagctttttcaacctcaggtggttgcttctggggtttgagttttccagagcccccagtagtggcagggagcataacgctttagagaccatagagagttgagagactggagtaggaagagaaaggtctgtcatggatggacaaagagatggagcaggtacgggtttgaagaggaatatgctgaaggatttaagggagctaaagggaagatcaaaagtagtcaaaggaagaaggaggaatggtggtgatgggaagggagaggtcttagatgagccagcttagggagtgcttatgttttcggaagaggccattgaagttcatctttagtaaaaatcaaactaacaagaagagaagcctagtttgtgccatagaggtgaagcatctaatcagcagtagtcttcagaggaggagaaacagaatagtgagaatgtctcctggaggaaagaggcaccgaaggaacagcaacaacaaaaaaaggaaacatgaatgaggtctctacaaacgtgatctgtacagaaaatgatttctctaaatactgaaaatctgaagttgaaccaaatgagatttcaataagaattttccatgttctaaaccaatgatgcttttcaaacaaagaagcctgggactctagactcaagaatatactcagattactgagaatcaaaatctgatgttaccatgcttccacgctttcgtgggtaaggagtcagacttaccaatggattcccaattaatcagtcaggagtgtactcaacattcacaaaattagctttgcagaggttaatgtcattaaattcactttagaatggataattcaaattcaaatagtaactcccttagatagatgtgtactagctcaagttcacctgttatctgatttcatttttaaaaaaaattttttaaaagtggtgttcgggaggtaaggaacaaggaagagacctttagaaaaaagtttcagtgttttatattggatatgaaaatatcagtggaatgtgtcctgaaaaacactggatgacagttactggacaaaaagacaaattattcccttttaccatgcaactgaacacagatttattgaatgtttttctcctgagtttaggttgcctctgggcaagagtataattctggcttgataacaccttgaagcgtgtttgtttaagtttgtggatagtttcatctattagtggaattaggcatctgcttctctttatgaacactgggtaccataatcttcctcttactttttgttttttctactcaactccaaaaaccattgctgagttgaagtagaataataaggggaaagaaacaaaagactaagtttgaatcccagtgctgacacttactggctttacgatattgtttaactcacttaccctttttaacctgaccttcttcttcactaaaaatgaaaaattgagtgaatttccctgggactctgttagataaggcaaaactaagatgggaacacatttcctaaggcgtagaaaaagacagtgaatgggacctttcttgttgtatcaggagttatggtaagaggtactaacaataaaaattaggctttcagccaggcatggtagctcacgtctgtaaccctaggactttgggaggccaaagcaggtggattgcctgagcttgggagtttgagatcagcctgggcaatatagcaaaaccccatctctactaaaaatagaaaaaattagccaggcatggtggcacgcacctgtagtcccagctacctgggaggctgaggcatgagaattgcttgaacccaggaggcggaggttgcagtgagccaagatcacaccactgcactccggcatggggaatagagcaagacttctttaaaaaaaaaaaaaaaaaaaaaaaaggccttcaaaatacccctacagcagcaagttggtaccagaaaaacactccaaaaaagggagtagatggtcatgagattttcatcgttcaccaacctaacttgcccatataaggaaaaggataaacttgagaacagtttcttgaatgagaattcctggaacagatcattcaaataggactaacaatttgttggacatgagaaaacttctatgacttttactgttccctttcttatgagggaggggagaagagtgcttttcctctttgccaagccaaggaagagggcttcaaagaacctctattatagtggcattcagaccattgtatttataaaaaataaaaatattttagaaaattgaatatctgcttgcacattttaaagatgacatctattttctgcccttgggatacagtaaatattgacattttaaaagggtttatagtacagtttagaatgtatcccgtggaatccaaataccattgcaatataatgtctaccatcatatacttaaaaatacatgaaaaagctcatatttaataaatagaagttttatattattcctttttatttaaatcatatttttcaacttccccaatgaattgtattctaatgtgataaatatgtgatacatatttatgctataaagttttattagccactctatcataattctttataaaattatatttatgtggacttaaattcaatttttaaaaacaatttcctgtgactacaaggctctaagtatttttaaaattctctagattgagtagtatttaaagtattaataataaatacacttagtaataaccaaataacctaaatatatgtaccttttgataaataattattaaacatactcagtggatagttattgaaaatgaatctattatgagatggatgggtatttgatggtaccttgagtaaagaaggatttcagtcgctaatattttgaattgtacttttatttggcataaatgtatcttgactacaatgcaccagtgggataggtcagagaggtgtgcttttattttgtaaagcggaagaaagtctgtcattaaccaaaaagtgggcaagaaaattggaatgaagtgcctaccacaggaacaaatccagtcaaatcttttttttgtttgtttgtttgagacggagtcttgctcagtcgcccaggctggagtgcagtggcgtgatctcagctcactgcaagctccgcctcctgggttcacgccattctcctgcgtcatcctcccgagcagctgggactacaggcgcccgccaccacgcccggctaattttgtgtatttttagtagaggcggggtttcaccatgttagccaggatggtctcgatctcctgacctcatgatctgcccgcctcggcctcccagagtgctgggattacaggcgtgagccacctcacccggccgcaacatgctgttttaatgagcgcctgggtgcgggcagcctcaggcctaaaatggcgttagccccaagtgaggactggacaaaggttttatagtctcctgtaaacaggaagtctcctggcctgacgtaactgctgcattgtacccggatggcctctttctcgatcttcagaggtacttgtcttctggccggctctcttcctgcttctgctatttcgccggtgcatgctgctcaggcaagtagccttgtgccttaggaatgggcctgagaaaggaggagttactcatctccttaagctttcaggcccgggagagaatcttacaacccactgatgagttatgaaatccatttaatgggtaaaataaaatagaataagatagcatagggtaccaaagaatataacgcaggttattacattgtgttacgtgtggtatgcttaagtgttgttttctggaactgttgttatcatttgtattgtacttcatttttgtttcgaattttaagataatctgcacagttttatagaaaatgagttaattagtactgtatcagtgatgtcatactgggttaattattacaaagttgggggtaaatttatccctgtataacagactttaaagataatataaataggccaggcgcaatggctcacacctgtactcccagcactttgggaggctgaggcaggtggatcacgaggtcaggagttccagaccagcctggccaaggtgatgaaaccccgtctccactaaaaatacaaaaattagctgggcatggtggtgagtgcctctaatcccagctactcgggaggctgaggcaggagaatcccttgaacctggaggcggaggttgcagtgagccgagattgcaccactgcactctagcctgggtgacagagcaagactccatctttaataataataataataattttgtttatttattgaatagatactttcttccagtacaaaattcaaaagcattgaaatcctctgttgcattgttgtctttcagccacacagtttctctccccatgtgctgccaaggttttcagtttcctgggtagccttccaagaataggatgtaggtgtgtgtgtgtgtgtgtgtgtgtgtgtgtatattattttctactcttgtcctcttaaaataaagccagctgttagaatactataaatactgtttctgcatccttcaaaagatggttcttttgaagcccttttccttggcttggcgagggcagaaggaaaagcactcttcttcctccttcataagaaaggaaagactaaaatgcctgtgtgtgtgtgtgtgtgtgtgtgtgtgtgtgtgtatagcactcttctccctcccttataagaaagggaagagtaaaatgctgtgtgtgtgtgtgtatatatatacacacacacacacacacacacacacacaggtgattattttctgtattagtagttaaagaactgtctctttttttttttttttacagttgcatactattctgttctaaggatataccataattcacttaagcagcactccaattagtgagcctttagtttgtttcgacttttggctaagataagaaaatgtataactttgtgcacatcattttacacgttgcaaatatatctatgtgataaattcctagccgtcgaatggctgcgtcaaactggcatttgtcttgttagtacattttgccaaattgctcttcatagaacatctcgtcagtattaggaaaggtttcttttccccatacccgtgcccactcagtgtgttatcaacctttttgatcttctaaacaagaaaaatggtgatatctgtcattttaatttgaattctttattcattttgtgagtgaatttgaattttttcatgtgttgcagaatcatttttatttccttttctatgcactgtttgctacttttttgttttttgccaatgttctcttttgggttattggtctctttcttactaaggcaaatatagtttacaacttgaagtaaaaacatggttttctatgataaaggttttaatgaatgttttctacaacagacagattctagtcttaaggttataacctgaaaacatcaaaactaacctttgaattgcataggaatggtctttgctcttcttagccatcaatcctggacagaagttcaacatgatgacaaattgtagcacaagtagagatttaaaaaatttttaactaatatgtaaatatttgctttcattttcttatttatctaacaatacattgatggctagaacagggtttgtctttgcaaagagcctgtgtcaactgactcccattctttcaaaatacattacctaaagaaggtttgtggcttctctttgcattgcattttctagccaaatctgaaataactatctggaagcttaacattttattcccacacttatttttccttgtgaaaatcaaaactgcactttcccagtcttcatgagtaaccacaatggtttgccatttgacttgccagttgtattagcatactgagatgtaatttatctgcatcaagagagttaattctgagcagctgggggctttctaatctctttacccatcttggacaccagttccctctcactgctatttgttttattctttgcagttagaataccattcctcttgacatacaagaaacaaacccaatagaaattaaaaggttccaatttctattttccattcaccaatattataccattttctcctaaagcagttctactctctcctagatcattctcttgcttttgaaataaaccttaaaaagtcattttgtcaccctaaatatgtttatactttcttgaaataatgcttttactgcatattagaattttagtttttacttagcagtccttcactactcctttagaaggaaatttagataatactttgaaggaagttatgagagaacgtcagaagccatgctatcagttttttttttttatgtactctaaagaaaactctgctctgcccatgggtgtcatctctttctgattctgtgtggaggagaaaaatgggaacacttccaatcattttcaaacaatttctgcttaagtggatgaatggaccacctggtttactaactataatgcccaggggatggctttgattggcagacagaacgcggtgcagaaacaatggaagttaaatgaggaaggttttaaacttgcaagttacctcccttggtggcattgactgttggtagaaaataacacgttgggatttcagatacattcagacatgctctgcacttgcaatttgcaatacttaaaacaacacaattcttctaatcataactttttaaaaaatttggccacctttctccattgtctcataaagctatattcatgaagctgtttattcacaaagtcgtatcatttaaagataagtgttatatccataagtatgtaaatgaattaaaatctgggaggctaacacttatccattccttattctactatatcctatctagagccatgcttcttaaaatttaatgtgaaactgttatttctggtctgtggaaccacagtttgaaaagcactgtcatagattcttaagtagatacattttcatgcatacaataaatatgcaggagaagttaaatgggtatgtccgggagtcaaatattgattctcagaatgaaaacttcttcatttatttctcagtgatcttcataaccctttcccatactgggcagtgagaaaaaattatcatctcactctgaaatagtgatttcaccagtctctttttatgggttgggacctcatggataatgaccagtcttttagatttccttgctctcctcctgctcctctccaaaatggcagctgggttgacagatgaggaagcattatacatgacctgagatctctatgcaggtacttgcagtctcctctgaccctctgctctctggaacagtgcctcttgtctgcctgataagtctctaccctgctgaccttgtggctctgagcttgtattttcatcaggaaatacggttctctgctgactatatcagttactaaagggattcttaaatctctgagttactgctgaagaacacttagaattctaaatttgtaattatgatacctctaaaaacaagcgtgattatccattatgtataaggatgccttccaaaaagttggagcaacttgaagccacttgttacattgtcatttagtggaggagggagtgaacttggtgtttacaggtagaactctctatcaggtgctgtgaggaaaaacaaaagcaagataaactgtggccataatctttgttactttatttcccaatggggagaaaaagacaaatatatatatttgtcaaaactgaacagatgttatttgaacattatactgtatatgccattataactataatgtatataatacatatatataaattattgaacactaaaaagaacactttaagaattatctattttattttttttattatactttaagttttagcattaggagaagtatctattttaaataaagctatttcactcttcagtttccatctcaagaactcataccaatttaaacttccactcatatttgagagttgagaaaaattaccaaatgataataatatattatctaaaaaataatttaaagatgcatgtctctaacaaaactatgtaacattctgaagggttttaagtaatacttcatatatcctaattcagaataaacttagatgttatcagtatgaaaatatatcataaagtaacatgattctctccaatgaagatgtaatcatccaaactttatgcgttgaatttacggcttagaaatgccatagcaatatgtcctcttgaatatacaattctatatactgagatttcacttagtatattaagttctgtatcactgaagagtatattatgattctaattaacaaatacaattctattttatataagtacccctatcatctactaggcaaagttagctgatgttactatgcatttttttgtcagctgtactcaacttataataactttgtattccaaatacttcaaaattgccatatgcttactgttttcctattcacatcattttcccccctattcttcctgaccctcctttgagcaatagtgtcagtgggattagactcatgcattcacatactgaatgaatgaatcagtatgtgattcatgatatagaaaatttaaattccttatatatttcatatatcatatatatgatatatgtatctgtgcatataggggatattaaacacttctctgtatatatctgacatatattttgaaaaggaaacaccgtagggccaagttaactgcttcaattattacttagtgtaaatgcattcagtttgttctgtaatttcaaaatgatacatataaaaaagtagagtttgcatgtttaatacatctgaagctacagtttccaaattctgaacactttggtgacccccttgacacaatgaatatttggcagttaccgaacataacagggcacaaataatatagttaatgaaaacatccataattatttaaattaggctattttaagaaaagttttaatttgaacattaaacagcttaaaatcatttataataattgattatgtaacatgctggtcattaaaatgagattggtattctctttttttttttttttttttttttttttttccgaggtggagtcttgctccatcacccaggctggagtgcagtgctgcgatctcagctcactgcagcctccgcctcctgggttcaagggattctcctgcctcagactgccaagtagctaggattactggtgcccaccaccacacccggctaatttttgtatttttagtagagacagggtttcaccatgttgaccaggctggtctcaaactcctgacctcaagtgatccgtcagcctcagcatccgaaagtgctgggattacaggcgtgagccaccatgcctggccaagattggtattcttgacattaataattttggtaagcattaagaaggcaaaacatggaagcactcacaataatgtataggatccaagtaaaattctccttactgaaacatgaaactacaaagccatgtgcgcatacttttaatttttaagatttgtttgaaggaacttttgtgaatgacaagtagagaaagtgtggatagatagcatctctgtctttaaaattatttgatgaaataggtgataagaaacacaaaaattaataattcatgtgacctttattacaatacgtcttctggtattagcatagtaataagtattagtgatttacataattggagagataacacaaatacaaattatgcacacacacatacatacatacacgttcctgtgcttcactcaaaactgaacagatgttatttggacattgtactgtgtatgccattgtaactaaagtccaatttgttagagatagtattgttattttattatctttagtatcttcaatgagtccattatgaatagtagcattaactttgcttatgactagcttaaatagaactttggactccataaaaatacgaacaaagatttttaatggctttagaatacagaagtaatctggtaaaagtattcttgattttaatagaaaccaaacaatcaatgtgcccgttagattaacagtgaataatcagattgttccagctcttcactaatgaacaatgctgaaacaacattctctgtaggtctcctcagatagacatatgagaacacctagaagtggaattgttacctcattagagtattcacatttttaattttatcatatattgcaaattgcttttccaccagcagcaagaagtggcaggaatttattattttaatttgcatatccctggttgaacaagttttcaagtttgttggacagatttttccttctgtgagttgactcttcatatatttaccccaattttccgttggattgtttactttctcttaccgattaatatgagttgtctgtatattctagattctagtagagttctggattatatgcacctaatatataagtctacaattccttatccaaaatcttatcgttgacttttcaggagactagtgaaaatggctacttagtggaacatatggaaatcatgagttataagtgtataaaggctaagtgcaacagtctaaagacctggtatcacagatgaagactgacatattgagtaaaccaggaattggctttattacataatgtgtcctttttcttgatttcagaaacccatatatttgctgtttcctgtacatgtttaggaagagtattcagaagagagaatgcagatatattgttgctgtttttttttaaaaaaatacgagtttaattcaattacccatttgattgcttgagtttattagttatggtagcacttagaaagagttgttttagataatgactatgattttggtacagaacctaatagtaaaaacaaaacatctttaattttatttaaagtgcatgtcagtcatgaagtcagaattgaattgctcttttctttgcttttaatgaaaattagcctaatggctgttttatctttaaaaagcaacttctagtgtttaataataacagatttaagtaaatattctgttaagacttaaagaaccatgtccaattactatatggataataacttagagatgctctatattggtttaaaataatgcaaatatcactggccactattcagagatatgtcaaaatcacttttgtttaatatgtgcctttctagtccttagatctactgtattccctaatccttttggggtatataatccagagatattaggacccattcagccagaaactgaaacatgccatgatggttagaattcatcagaaccacactcaaatgaatgttaagagacatagcgtgataaaagtgcatctgaaagagtatatgaacagatgacattacatacaatgttgtatataagagaaaggaaggaaagacattcatatcatgtcatattaattcatgtacactgaaaatacagaccgtgaacagacattctttcatttgttccttcatgtattcaataatagaatgcttctctaccacagatgattccaggggaatttggcaattgctggagatatttgtggttgtcacacatgggggaggagaaagtgctactggcatcttgtgcatagtgaccaggcatgctgcaaaacaccctgcagtacacagggtagctcccgacaagaaataattatccagtcccaaatggcaatagggctgaagctgagaaaccctgattgaaactcacattacatcctaatcgaaactactttgttccgttctgagccgtaggattcatcaaataaaacctactttttattggtacaatatttaaatccagagaccctgtagcatagtaattatgtatgcaggatttgcctcagaaagactagggttcaaatctcagattcaccatatgttaggttgtgccctaggcaagtttctgacctttcgtgactctagttttttaatctgaaaaaatggtaatagtattgctgagaggctctgcaatggagattgagattaattaagatgatttatgttaagtgcatagcagagtgtttgcacttagtcagtttccaacaaatggtagcagtattacctttacatgtactaaatcatttcatcctgacctactatgaaaagcctgatcactttccatattttactgtttttaagataccattgattagagtatgcattgttattttatttttcaccaagaaaaatgtgctgccgttttagactatgacacgctatcatttataaaacgtgtcccaatttcagagcagctaacctgttgaaataaaatgtgagtcttataattgattattgtaaaacacaacagtaagtcttctttgattaggtgcaactgaacaatactatgaccacattcagtagcaaaggcacttagaaggatataggaatatagcttagcaggaaggtagcatcgggtatctctctttagtaggatgagtatgcgtagcaatctctgaagcacccagggagccatccaagagctattcactttgcagcacctgtccactctctcatgacatctcaggtgcacaggaaggaaacaaatcgagatgctgggtcaaccctggcctagaagccttatgcatcccagaggccaatgccttgtaacatagtttccaaggtcctcaaaaaggacatgcttagttacaagaattgttgtacttggggacgccccacaattatggttttccattaggtatttatagttcatatgtagaacacctaaccaaggtgtaatttaccagtccccatcatttttttttttaatctgaagcaatgttgcctgctcacacatttgacattccaactttatcagttttctagggagaagggagctagaaagttgatcaaagtacaaattctcatacagatggacaaagggtgtttttaaccctttactcacagtaatatctgttagtttcatttattttatatttaaagatactgaaacctgaaacttagagcagttaaatgacttgccccaactcatgggctaataagcctagaacccagatgttcttatttctagactgattatttccaacaacactgtaatatcctaaagcaagagtcagcaaactatggtccaagggccacatttagtcctccacctattttcagaaataaagagttattggaacacagccacatttatttgttcatgtattagacctgactactttcatgccacattggcagaatttgagtttggcccacaaagtctaaaatatttactatatggtgttttatagaaaatgtttgctaacctctgctctaaagtataattacaaattggccaggtgcagtggctcacacctgtaatcccagcactttgagaggccgaaatgggtggatcacttgaggccaggagttcgagacgagcctggccaacatggcaaaaccccgtctgtactaaaaacacaaaaattagccaggcttggtggtgcatgcctgtaatctcagctactctggaggctgaggcacaagaaccgcttgagctggggaggcagaggttgcagtgagccgagatcatgccactgcactccagcctgggcgacagagcgagactgtgtcaaaatagtaaataaataaacaaataaattctaattataaattgtttaactctttctatgagtctatataaggagtttatagaaaagcatttgtttctaatgtttgattattaaaaatacccctgtattttttattttattttaattgacaaataataagtacatatatttatgaggtacaatgtgatgttttgatatatgtttacattgtggaataattatgcatacttgaaggattttagagccacagagcctgaacctaaccgtttctctacatcagtgttggccaacttttttctttaaaaggccaaatagaaaaatttcagtcagtttttgaggcttcatgggccatttggtctctgttggaaatagtcaattcatgctaggattggaacctagataaccagactcaagagcccatactcttcaccagtaaggacttaggaaggcagcaagacctgggagtaccagtttaaatgaatgttcttctaagcagtgtcctgtgctgctattaaaccagaccagagctttggcccttagttaagaactgtatgtataaagttttccaaaataatggcttcaggttttcacaaagtccttccatccaaacaatgcagattgtacccccttaagaatctgttcttaactgccatctgttctctgcattcttaaagtctaatcttaatacagcagccagaatgatctgtttaaaaataagtcagatcacatcactcctctgctgaaaactctcctatgcttcctaatctcactcaggataacagccaagatccttccaaagatgcaggacctatcctcctccatccccaactctatgactatcattcctactactctccccttgctcactagattccactcaccctggtgtccttttttttttaattgaacatacacatacactcctgccccagggcctttgcacttgctgtctctgcacagattgttctttcctgagatagctacttgaatcgttccctcacttccttcagatctttatttaaataccacctactcagtgaggctttccctgcaggcactttctaaactctccacatgccacctccctttgccccatacctaagtctcttattcctatccagtgctttacattttgttctttagcacttttcactctccaaagcaccttaatttctcttttactacacattatcaccattagaatgtaagttttatgaggacacaaaaagtttgtctgttttattcgctgttacatatctagtacctcaaacaatgtttagcagacaataagtaatctgtcaatatttatggaatgactcaagtgattttttggaagagttttggtaatatttcatttgccaaaagaattctgccaaaaagactttgaaacccccactttaaggtggagagcttccatagaggcttctggatgttacttgatggtcacacctatgcccactctttcactggccttgaacatttcaagtatgcagcttagtagattatatcttcacagtttcacaacactttccagtttaaaaatcaatgctgcattatgctttgtatatttggacagattatttttgaaatccataaatctctaagttttttttttttaagtctccctttggtgagctgcccttgattagttcaaaatgggaagagagaacctgtcattctttgtcaatcaggttggcacgtacttgacagcatgcagttatagtgaaagagagctgtgttgcagtggtctagcaaacctaattgtagttaagtaaaagaacagtcacccaacatgagaggaaagacaaagaaactcaactgaacaatgttgtgtttttccatccatcagccttcatttgtcagagtctgactgacaatctggactgcagaaatcaggctctaacacaatattgattccatttcatattttgtttcttgctacactttttagcaaacagtttctgtatggaatgagagatagtgcagtcaatatatgcgaccagggcacatttatattaaaggcttactttggtttttttgtcccagaaatcacatattgtttgtttgttttactataatattgtaattgtcagctcttgctgcagtaacaaacaatgacaaaattccagtgacatataacaacaaacatttattactcactcatgtgtctgcagatcagctgcagctttactccacactatgaatcaagttaaggtcttttcattctagaatatggatctgctctaaatgtcttctcatcccaggaccctagcggaaagagcagcttttatatggcatattattctctcatgatggaagataagaacaaggggaaccagcaaatcttgaactgcctttaaagttccagctaagagctgccacacagtcccttctgtctgtccatggtctattggtcaaaggtacacagtcaagcccaaagtcaatgggaagggaagtatattcactgcagggcagccatattaagagaggaaatgaataataatgaactgacaaatcaaccatagtatccacaaatgtcttaggatttcattgattcccaaatgcattttttagtatttcaacacctctgaacttgagatatatcgtacaatagataatgtttacaaagtgtaggtttttttgttttttggctttcttagtttacataacaatagtggcccttatcatcaatgatagattagatagaaaaactgttaattgtggggttgacaaaatagccaaatggtagaaggcactccttataagtaagtaagttatgagtgggagctaagtgatgagaacacatggacacatacaggggaacaacacacaatggggcctatcagagggtggaggttgggcggagggagagaaccagaaaaaataactaatgggtactaggcttaatatctgggtgacaacataatctgtacaacaggccctcatgacacaagtttacctatgtaacaaacttgcacgtgtacttaaaataaaagttaaaaaaaattaagtgaatggacacttaatgtttacaaaaaagttgtcatttttatcttgaatttcttttttctgtagcaatatttatatctcattcagatcagcttatttgattagaaaaccaagcattaatagtagatcttatgtctatttattcacatattcatataccttcatttataaatatatattcatatatatttagaagatcaattggaaaacataagtgccattcccttatttaaaactcttgtagcttctccactacagttctgagggtggtatacaagatccttcttttctctggcttttgctttctatttctactccattacttcccattcccctacgtgatagctccgtacttcttctgcttcctgtctttgcatgttccatgttccctcttggaatacattctctctgccgtccatccccttataatgaggtgcatgagctgtttctgctcccagcctttctgtcctgaccttcttgtctatcaaacacaaaagtgatcagttcctgctctgtgctccattatacattgcactttactagttgttatacctgacctgctctaaatgtagtatatatttgtgtgtctgcactccccattcctaccccagtgaaacatagtaagcactgaataaatgtttgtcgaatgagcaaataaataaataaataaataaataaatgtttgaacatacatggaaaggttgtttatgtcctccttataatgtgctttgagatatatattcttaatatatatataatcatatattctaaggttattagtaggtaaaatgaaaatttaaagaaattgagtacaagaaaggaaaacaaggaagaattttttcctttttgtactatttctaagaacaccaaatttctagttaaacacacgcacacacaatcggcatgatgtagaattagaaatatgttgaataaatcaattattagaaaatgtaaatatatattaatttgcctctgacttgctacttttaccctcaagggttttttttttctacctcttttcatcactaatctttgcttcactgcttgtcagatcagcaactgcccattattagtaatgccatttaataagagataaataaaagtaaaggtgcttagagttactccatttcaaaaacctatcagggctggatttcagaagagaccatgaaattctcctactgttattgaaccattactccctattacctaattaatacaagttattttcttaaaattatacctgacattgtagtgaactatcaatactatgaagaaaatcaaactctcctcgtatcataaggatcttaacacctggtacacaatcttgcattggaggggacattaagaataaggcatggaggaaaaaaaaaccttaatggaaatgttctgttattagaaatgagactttttggtggaaatcccatgacgactttcttgtctgaatgttctttgaagttgaacactttctccttacacaagccggccactataattagctatgtttccattttagtggtggccttcttcaccttatctgaaatcatataaagatgtgaggccatttgcgagataaaaggtttgctcaaaccagttctctgacctggatatcagaggtttggcaatcataaacccactaagagaaaccctcagagctattacaaggctatgtaaaactttatttcattttttgtgagaagggacaggattttctctcatttatattctggaagaatattgtagaatgtatttgagttcaagaggaggagaaataattaacataatattaagaaacgtcaattttggaaagaaataataagcatatatgcacatgtgcgtgtatgcacacacacacacagtatacacaacagattcagaaagaaggaaatagagatttggtgacacatacttcctggatataatctcaactctgccatttgcaagccacatggtcttggataattgacctaatctctctcaattgcagcatctgtgaaattagataaaactttctttgtaggagtgtatgtgtgtatgaaaagcacagtgtttgacatataataaatgttttagcaactgtagcttgttaatattatcacagcagttaatatcactatagcagttagttgccattttcagcacagctaataattttagtagcattttctgatctttccatctcatgtggtttctttggagttgtttcttgctttgttttttagcttttctatgtcacattttatttgcatggagaaataacaaattttacaatttatttcacatattctttaatttttaggataattgtcagtttcttacagtttattttccttatactcactgaagaaaatatgtacgaaagaatattttcagtgaagttaattggatttactacagttgacccttcaagcaatagtatcttgcccttaataactgacctatctttgaactaataaattcaacctgcaaataaatgtagtgaggtaaattgtagaaatttatcttcaaaatggtctttctaaagtgatctatcaaaggtgcatttaattagaggtccagttctccaaaaatgtgccaaggaaaagtagccacaaagaatttagagctgaaatgaattctttcacccattgctctgtttctatagaactgagaataaatctcatatgggtacttaaaatctgtactatgtcattgaaggatgaaaagatgacaatagtgatgatagaaggacacggtaataggaaacatttcaatagagggaaatgatgtgagtatgcaatgttcattcaccagaggactaaatctagggctattttggtgacttgaacagggaatattctacttcctgcaagtgaaaaatatggacatttcatttggcatgccacctgctcttcagtccatcatgtagcaagcacccacttagtactttggagctctaagtaatacttggactactcaaatgccagccttgttgccatttctgtttattcgccaataacaattttattaattaaaatttgtatgtggatgtcttaaggaaattccttgtagttgtcaaagcagactcctgatcctatctatctgccagtgccttctgagtagtggtatctattcttcatgatttttggaactatttatgggtgattgaagaatatggagtggatagagaaggatgctagtcatttggctgcacacaagaaacacagatgaaatttttgactatttctgttcattttctaaaggtacagaattttcactggattgtacttgtaagcaattttaaaggaagaaatatccagccttttgaatttgttacagtgttgcaagacttttttaaaatgttaagaatttttatcatataggatgaattaatactctcataattttaggtttgtttcttccataattaataactatccttaaagattgtgtgtgtgtgtgtgtgtgtgtgtgtgtgtgtgtgtatttcttgattttccagagcaaacgttcccattcatttgttttactcaccttgttatagttgctcccattgtaagatatatctagtaagtttactgttgttacctaaatctgtttgctgaattttaaaaatgggaacatgtagtaaatttgggggaccacgagctagtatttacaaagtaaaccgagaacattggatataaaaccttatttcatttaacctccaatgaaggatatattcagtattattatttgtattatttcttgagcttccttgcttatctgtaatatgtaacatggtggcaccccttttcatataattctctcctcacttctattttgggtttttacatgttcttgtttcagtctcttctgctctttctatcttttcttggttcaactttcttctcttatcctgtggaggcgaatacctaattctggctctatcctcttcagtcactctacaagtatcactgggacaatattgtccaactactatttttacctccaaacctgtattcttagccttacccctaatctgcacactacgcttctttttgcaattactttctgtacatttgcatcagtgttaatcacaggcatcttgactcatgtctccaacctgaaaacattattccttccatatagggacaggctcctctgtcttccctgtacccctagacagtttctcccaagttataaaatcttggtgattctgaaaattttctttttccccatcaagtcctgccagtcctttatccacaacataggaataatacttcctgaacatccgtgctgctcctgtttgttcaataagtactcggacctctaaaggcatttcctatgtttcttccaccagccccttatccttaaaatcttgcctccaatctgccgctagagttatcatcttaaaagagtcaaatcagggttggtatccaagaaatattacaaagtactaagctcttggtatatacaatcaacttgagagaaagagagggacgggaggagagggagagagagagagagagagagagagagagagagagagagagagagagagactttattctgtcctctataacacctgaatgattctgtacatatttatgttaacagagcattgtactacttcaaatccttatacaagcaaaactcctcaccgccttttggcaatggaacttgcttttccctctgcctgaaatagtcttcagtatgttgacatgactcatttcttcacttcattccatttcctgaagagaggagcagtcttctgtgctcacattgcctaaaatagagcccactgtcactctctacttactctttttaatctttcttcatagcatacatatacatatatatacacacatatacatatatatacacacatatacatatatatatatatatgtatacacatatacaggcatacctctgagacactgaaggttcagttccagaccaccataataaagtgagtcacatgaactttttggtttcctggtacatatagaagtcaggtgtacactacactgtaatctattaagtatacaatagtgtatgcctaaaaactaatgtacatgccttaatttaaaaatatgttattgcagtgttcaagctgagagccaaatcaagaatgcaaactatttacaataaccacaaaaaataaaatatctaggaatacatctaaccaaagaagtgaaagatctctacagggctaactacaaaacactgctgaaagaaaccatagataacacaaacaaatggagaaacattccatgttaatggaaaggaagaatcaatatcattaaaatggacatactgcttaaagcaatctacagattcaatgctattcctatcaaactagcaatgtcatttttcacagaattataaaaaactatcctaaaattcatatgaatctaaaaaacagtctgaagagtaaaaacaatgctaagtgaaaagaataaagcatgatattaaccaacttcaaactatactataaggctacagttacccaaagagaatgggacttctacaaaaacagaaacttggaccagtagaacagaatagagaactcagaaataaagccgcatacctacagccatctgatctttaacaaagtaaacaaaaaaaaaaaaaatggggaaaggactccctactcaataaacggtgctgggatagctggctaaccgtatccagaggaatgaaactggactcctacctttcactatatacaaaaattaactcaagatggattaaagatttaaaaaaataaaatctcagccaggtgcggtggctcacgcctgtaatcccagcactttgggaggctgaagcaggtggatcacgaggtcaggagattgacaccatcctggccaacatggtgaaaccccgtctctactaaaaatacaaaaaaattagctgggcatgctggcgcatccctgtaatcccagctacttgggaggctgaggcaggagaaccgcttgagccagggagtcggaggttgcagtgagcccagattgcactgcgccactgcacttcagcctgacaacagagcgagactccgtccctaaataaatacaatacaatacaataaaatctcaaactagaagaatcgcagaagaaaacctaggaaatactattctggacatcagccttcagaaagaattcatgactaagtccttaaaagcaaatgtaacaaaaccaaaaattaacaagtgggatctaattaaactaaagagcttctacacagcaaaagaaactatcaacagagtaaacagacaacccacaagatgagagaaaatatacacaaactatccatcagacaaagatctaatatccataatctatagggaacttaacaagcaaaacgcagataaccccatgtaaaaagtgggcaaaagacatgaatatatagatacttctcaaaagaagacaaacgggtggctaacagatatgaaaaaatgctccacatcactcatcattagagaaatgcaaatcaaaaccacaatgagataccatctcacaccagtcagaatgcctattatcaaaaactcaaaacacaatagatgttggtgaggctgcagagaaaagggaacattatacgctgttggtgggagtgtacattagttcacccactgtggaaagcagtttggggatttctcaacttaaaatgcactgtcattcaacccagcaatcccattactgagtatatatccaaaagtaaataaatcattctaccaaaaagacacatgcacttgtatgttcactgcagcactattcacaatagaaaagccaaggaatcaacctagatgaccatcaatggtggactggatgaagaaaatgtggtacacatacaatatgaaatactacacaaccattaaaaagaatgaaattatgtcctttgtagcaacatgcatgcaactggaggccattatcgtaaatgaattagtaggaacagaaaaccaaataccactttgttctcacttataagtgggcctaaacattgggcactcatggacataaagatggcaacagtacatactggaaactagtaggggaagagataaggaaggggcaagagttgaaaaactaactattagatacggtgcgcactatctcagtgacaggatccatcatactccaaacctcagtatcacccaataaatatataaatgtaacaaacctgcacatgtaccccttaaatctaaaacaatagttgaaattatttaaaaaaatactttgttgctaaagcttgctagcagtcatctgagccttcaatgagtcttaatctttttgctgatggagggtcttgccttgacggagatagctgctgaccgatcagagtagtaactgttgaaaggttggagtgactatgccaatttcttagaataaaacaaccatgaggtttgctatgttggttgatttttttcacaaaagatttttatgtagtgtgtgatgttatttgataacattttacccacagtagatctttcaaaaatgaggtcaaggctctcataccctgctgctgctttaccaactaagtttacagaatattctaaaccctttgttgtcatttcaacattgtttacagcgtcttcaccaggagtagattctgtctcatgaaaacactttgttttgctcatctataagtagcaactcttcatccattgaagtttcattatgagatgacggccattcagttacaccttcaggctccactttattctagttctcttgcaattttctccacatccagtgacttcccctactaaagtcttggaccctcataggcattcatgagggttggaataaacttcttccaaacaccttgtaatgttgatatttacctctttctatgaatcacaaattttcttaatggcatctggaatggtgagtcctttccagaagattttcagtttacccagatccatcagaggaatcgctacctagggcagctatagccttacaaaatgtactttttaaagaataagacttgagagctgaaatgactcctttgtccaaggactgcagaatggatgttgtgttagcaggcataaaaacaaaatctcttggtacatcttcatcagacctcttggctgaccaggtgcattatcaacaagcagtaatatattgaaagagattttttcttctgtgcaataggtatggccagtgggcctaaaatattcagtaagtaaaccatgctgtaaagagatgtgctatcatccaggctttgttgttccctttatagagcataggcagagtctattagcataatcttaagggccctaggatttttggaatagtaaatgagcattgtcttcaattgaaagtcatcaattgcattagcccctcaaaagagagtcagcctgtcctttgaactttcgaagccaggcattgacttctctctagctatgaaagtcctagatggcatctttttccaatagaagactgcttcatctacactgaaaatctgttgtttagtgtagctaccttcatcatcttagatattagcttgatcttctggatagtttgctgcagcttctccatcagcacttgttgctccacctttcacttttatgttacggagagggcttcgtcctaaagcctcatgaacaaacctctgctggcttccaacttttcttctacaatttcctcacctctctcagcattcatacaactgaacagaattgggccttgctctggattaggctttggcttaggagaatgttgtggctgttttgatcttctgtccagaccactaagacattctccatattaacaataaggctgttctgctttgttatcatttgcatgttcactagactggcacttttaattttcttcaagaatttttcctttgcattcacaacttagctaacgggcacaagaggcctagcttccagcctctcttggctttcgacatgccttcctaaccaagcttaatcatttctagcttttgatttaaagtgagagacatgcaactcttgttttcccttgaacatttagaggccatagtacggttattaactggcataatttcaatattgttgtgtctcagaatagggaggcccaaggagaggaagagaggtagggggatgactggtcagtggagcgttcagaatacatacattaatggattaagtttgccatcctatatgggcactgtttgtggcaccctgaaactattaaaatagtaacatcaaagattactgattacccatcaccataacagttataaaaatattgaaaaagcttgaaatattgtgagaattatcaaattgtgacacagagacatgaagtaagcacatggtgttggaaatgttgctgatagacttgcttgatgcagggttgctacaaaccttcagtttgtaaaaaaaaaaaaaaaaaaaaagcagtatctgcagagccaataaggcaaaactcagtaaaatgaggtatacctgtacatatacatacatgtgtctatatatccactcacacatatgtgtatgtgtattatatgtgcatattatacatatatgttgatatgtgtatttatcatatctaatacacatatatgtatatacatgtatatcacacacatatattcatattgtaaattgaaaattttctagtgctgtatcccaatctctagcttataaatatattgaatagatgatgcagcaggtatcttttgaatacgcactccaattttagaaatataaatcttttttaaaggttggaataatataagtagtttggtgttcagtgcaaaaggttttaatgtataaatactatgaaaacaaaagttagatcaaatgtatcaaatacaaatgatctgtattgggggacagagggacacattaaatttaagggaatatgaggagaatattgacttcctatgctcgatgagtgaaaaagaaaagtgaagtgggagtgtttgaaaggaaagatgagcttttccatgctagtacatcacaggttttaatactcatagaagtttttagatttgtataggaaatatgatcctccagcctttccaagtttactcttctactggaattacaaatcaaaactaataaatgtttactatgcttcaagtgcaatagttataaagtacctgattagaggtcccacattcagatgttggttatataaaatattcatgctaaatcatataaatgctaaaacatttgtatttgtgatgttctcttggattgctagatggagattaaattatacaaattcagctaagaagaaaaatgtgggataaatggaattttagtttaaaggaagtcaatgaaaggattaattaagtataaaataatcccattttaatttgtcatagaaatgagttttctgagacattgttgtaatcaataacgtgaagatgtaaaattttgcaaaaaaaatcattacgggaaatccaaaagcagaagagtagactctgtatttaactctagcagattatttagaaagaaaatagtctatgccatgaacctttcgactgtctgcgtgaacaaatgtctctagtaatacacactcttaactcaattcccataggctcaaagttgcaacagtatttatttgcccgttcaacggttttttgtttagcacttactatgtgttaggcacttccagggatatgagtgaacaaggtagttatgggtcttactctcatagaggataattctttaggaatggtcaaaactatacatatacacataatgtgattaattgtgatgtgttttgaaggaggaagcaaaggagttggaacagtttaaataagactgtaggttggcagtgggaacaatggtctttgctatcatttttcaaaaattccaatgaatgggaatgacgactgttgcattaagttgcctgtctccctctgacccatagtgattctctattatcagagaggtagggcatgtttttcagcatatgtgataatatcaaacagattcagatggtgaaagtaaaatttcttaatgcttagaaataacataatttgatcaaatcatttggatatgttattaagttgttgtaagatatgaagacgtagctgttactactgccaatagtataaactttggattcagacctagctgtgtttgaatattaactctcccacatcccacgaggttgtgggcaagctattcacatcattgtcactaccgtcactactatcccacccacccttgcttcattttcttatctgtaaagtggcaatctgttggaatcagggttggggaaggcaaatagtagtcattatacgaatggtaactatgctatcatcaataatatagtctacagctatgatgaagctaatcagaaaacattgtctattaccagtaattagctatatcaataactatcacaagaaaagtcccagctgtcagtgaataaatagaaaatagtgctttgtcttagagaaacacatacaaaatgaatggtggtgacagtgctttaagttaacttgtcagtttatatgtgtaatgcatatataatttcaaatgtataatttagacattgtacatgtatatttggcctggtaatttatggtatacataaatgataaatgtataggttgaaaattcagttactttttttccttttcttaaatcatttttaccttgctgaagatatgctcttttctctacttccttagaataatatattttattttctcttaaagtattttgagaccatatcaccatttactacaccaaaatgtttttttgcaaatgcggtattcaagggtgaatttatagtggctggggacctatttggaattcagtaagtaaaactagattttccttattcctcatctgagatcagagctatttctacctctagcaaagacatacagtcattccgggtgctgcattttcagggaacaatgtgttttcttggcaaggggcagtaagaccatcaattaatagttcttcatgtaaagtagctaaactactgttataaaggaagtgaaatttgcatacataaccattaacacatgaggttagttatgtacaattttgaccaaagtgcctgtttgctgctggtatttattataataagaactggaaaaaaatagtctatctcaagagcatgtgctgagcacccgtaaattgcaagagactgtactgggcagtatgagattatagtaatttgggatttcctactaatgaactgagagggaacaggtacaaacacagtatacgaaggaaacagtggcacggagacacttaaacacagcagtgctgggaggctccggggtaggggagggaggaagagagatacgggttaatcaggagctgctctctggggaagattgcccaggccctgactgatgcctgacattgattaattgatactctatcctagtgtttaacaagtgttccatccaaaaagtcttctgtaatatttaacttcacttccttcagcttcaatttctgcacaattcttttgtcgtctcatcaagagagctagtcagcagacagtaacaaaatgcttatattcatatacctgaaggatttttttttgtcatgcttcagccttctccagactgaagaaaagcaaataataaacaaaattaatcgttcttcagaaggcctgtttgactcattaataaataataagctttgatactgtgctttaagtgtttaccctttggaaagaaaataattttgacagtgatgtagaaataattatttgatatttatttcaaaacaaaatttatatccaatactaaacacagaattttgtaaaacaataagtgtataaagtaaaatgaacattaggattattgagattattgtagctaaaactagtgtttattcatataaattatgttaataaattgtattgtcattattgcattttacttttttgaaaagtagttaatgcctgtgtttctatatgagtattatataattcaagaagatattggatgaattttttttaagtttaatgtgtttcacatctctgtttcttttctctgcaccaaaagctacatttttgtgcccttatgtaccaggcagaaattgatctgcaatacatgtggagtctccaagggtatatttaaatttagtaattttattgctaactgtgaagttaatctgcactatatgggttcttttccccaggaaactgaaatagcagttcaagctaaacaaccggatgtggaagagattttgtctaaagggcagcatttgtacaaggaaaaaccagccactcagccagtgaaggtaatgaagcaacctctagcaatatccattacctcataatgggttatgcttcccctgttgtacatttgccattgacgtggactatttataatcagtgaaataacttgtaaggaaatactggccatactgtaatagcagaggcaaagctgtctttttgatcagcatatcctatttatatattgtgatcttaaggctattaacgagtcattgctttaaaggactcatttctgtcctggtgtgctgccatcaatacaaaagtagtcccaccttcaaggtagattaaattctttggggctttattgctttgcttgccagccttgatgcttttcatattgtttggtttaattcaaatcaagctactgcatcatagtgtctgtctccaacagctgtaaagaatcacaatatggtccgtgacctttcttttctttgttgctctttcttataaaagagtaaaatcggcattgaggcttcagtattttattgggtcaagaatttttagtgaaatgtcatgtaattgcttatttctttggcaaaaagctggcctgggataaacctttctacttttttttcttctccatatccatgttgaagtctaggtcacatttattcacaggctattacataaggagggagatggaaagccaggtcagttttcaaaaaatagctaatcaatggcttccatttgcaaatgagagtccagtgctaaatatacgttagcagtaggttacctgattctctgtacctgaccagaattataatggctcccattatgatgaaggttcctgagatcctgtaatcatggctgtttattgatcagtcttggtttctcagttaatgttgcaggcttggatacaatgaacctcgtcctcatgtttaaaactgcttgaaaacagttcaggtcaataacctcattatacagaaccagtttgtccttgcaaacaacattaccatgacttagattctgtctctaaggtcgctgcttagtttcccttgcgcttggcccaagcttcatttctagaagattgtttgttttccttacagcttacaagagacttttccttaggtagagttgaagtttgcacctgagcttaatgtccaaacaccagacactgaaaatcacaggtttctctgtagatatcaacatacttttattcagaaatatattgcaaccactccaaaaatctagaaaagtagtttgtatccagttcaagcccagtataatcatttttcataagctaacaatgtgctcagtatttagttggaagagctaggcaaagtcctgaaagcagcaaatttcagagtttccgttgatgttctgaagaaagccagccctcagagcagttaatatggtgactttcattgtagcaagccatgcagtgcacaaatggacaattgcatacgtttctatctactctttgttgatcctcaaagactttatgccttatggtgtatgactatgaattaaggtttgtcactaattgttagagatcacaaaggtacatgtaatttggcttttacttttgtgcctttgtaaaagagagagagagagatcttaattaaaagccactgagaaaatttttgctttcattatgtataaaacaatccaaatgcttgatgctaacttatcgcacctccacccacacactcaactactgggccacttggagatcagaactgggatctgccatgcctgagcatatctgcttcctgctgatgcattagtgatgtaaaaggagaattacttttctgaaataaaaagaaagaaccaggagctgttgctttccttctctttcacaacccttaaaaccatttttgtagcagacagcactgtttttttccttcctttttttttttctccttccctgtttccctattttctctcaatttgacacattgggagaagctgaacttaagggaaaatttattcctgtcttcccatttctcccttggatttggagaaaaatcaacatatcaagttggctgggcatggtggctcatgcctataatcccagcactttgcgaggccgaggcaggcggatcacctgaggtcaggagttcgagacctgcctggccaacatggtgaaaccctgtctctactaaaaatatgaaaatgagccagctgtggtggcaggcgcctgtaatcccagctacttgggaggctgaggcaggagaatcacttgaacccgagaggcagaagttgcagtgagccgagatcgcgctgttgcactccagcctgggcgacacgagcgaaactccgtctcaaaatatatatatatcaagttgataggggcaaaaatgcaagaatgatttgagaattatggggtttaaaaaaatagttgactcacgcacaacttttgctgtggaccatgaccttggaaacatctgaagattagctggggtttgcggtagcctgaaacacctagaggctcaaaaaatgacctcacagttttgaacatgacacccagcaatacaaggcagaaagctgtgagggctgtttaaatctctgcatggatcaaaaatttatttttaaaggttagagatgatttttctgaaggacactccattgctctgatagaacgtgaacaaagcctttttaaactttgagtccatatatcaaaatttaaaatttgtcctatttataatgcctcttcttcactctgggtcttgttacctcttaatagaagaggaaatgagtctgagtagcctgcagcacattttcatgagagaattgtgtttctgtttttgttttttgggggaggtgcatttggaaactgtaataattatgaagaaaatgatattctttaaaaagaaaatgaaaatctctcacgatgtatatgcaagatctagtatttaaatgcataattagtgtgtccaccgcttacaaacattctaattaaagacacatcagggagcaattctgtttcttaggaaattgacttgtctattggcacctccgcattctgcatcagacagcctgtctgtccagctcctacgctcacctcccaagctgagttctgattggaagctgggttcatccctgctcagtttctttcctctttcttctttccttcacttcgtcaacttctttaagatttcttttattttcaaagatggtatatttctggtttcttttttaaaatctctgactaaccaacttctttattttctttgaggacttcctgtaaaaggtcaaatacatattatgaaatgataatactaatgacgtataggtagtactaatctctgctgcaaaataactggaaaaatcttaggatcgtatgatcaaatacctctccatctttgtttagcacttcaactctctttctctctctctgtctctctctctctctctctctctttccctccctccctctccactctctccctctctccctctctccctctctccctctctccctctctccctctctctctctctctctcccccttcctcccccatctacacacatacttttatttatttgtatgttatttcttcatcttaacttcagaaattactgaagactgactatatgagttatataaattgtttaaaattttgctaaagttatagttttggtataatatattacattaatgccatagatgaaatagtctttaatgtgttccatttttccacacagtaataactaggtcctcaatagcaccccatttagcagtttaaaagcagcaaaaacaactgctatcagtaacaacaatataaactacaaaagaagccatttgttatttgatttttattataaaattgtatttttaactgtcttgagcttaagcatttaggtgccattttcttgtattcatactcatttttaacttaagttggaaaactacactttcagttaacttttaaaaatatgtttatgtactttcaatgcttacatcacctgccatgtattagaactgagagcattaatggaattttaaatgtcttggttactttctaaagtgataaaatgaagccagctggtttgctttgctaactttttatattatcaaaaaatgttacttacacaaacctagtaatatgttttacttactgctcttgaattatttttcaatgtaacagaaaaaggtgtgaggaactttctgtatttggccaaagcgttccatcccaacctttaacacaaaataattgctgtagacaaatggtcaagagggcaattataatcttccaggcatcatttcctcagatatgaactgcaaaatgacagcatcattagtcattttcaattacagtcagtcacaaccagggatgattcattttcccagctgttttgttgttaattaactagatgaagctgtttttttttctcccaatgagtttgttctactgccaacatcaacatcttaacatttttaaaaacttccttagggtttattttttgcctaacaatctttaatatattactcacaaaagatgtgcatctcaagatttatccacggtatagcaggtcaaatggtatttcattggtcgaaatgttgccgaaataaatataattacacttaaaacaatacttggatttcataaatcatctgccatgcgtacaatctcatttacctggtgtaacttcacttgtagcaacagaaatcaatagagagataacagacaaaaattgtcccctgaaatgaacaagtctattttgactgactcatttattgagcacaatttccatgccaataacaccagaataagttgggagaggacttctagaaagaagataacaatattagaggcatttaataatttataagtaaatgcatagcaacattttatttttttaaattacaagtttgcgactgggcgcggtggctcgcgcctgtaataccagcactttgggaggccaaggtgggcggatcacaaagtcaggagatcgagaccatcctggctaacatggtgaaaccccatctctactaaaaatacaaaaacaaaattagccgggcttggtggcaggcatctgtagtcccagctactcgggaggctgaggcaggagaatggcatgaacccgggaggcagagcttgcagtgagctgagatcacgccactgcactccagcctgggtgacagagtgagactccatctcataaataaataaataaatacaagtttgctttacaactgaaaaaaaagtcttggagtataagaggttgaataaatgctaatcccaatgcataaacttgaggagagcttcactttcccaatgagaagagaaaaaatttataatagatttttgggcaacttgtaaacataaacatttagaaatatggatgagattgtcaaatgtctaattatattcaatttcttaattgagtagcatttccatatttgcagtcttacattttataaaataacacactcatttagaaatacctggcacatttatattttatgaaacaatttcattcaaacccttcgtatgtatattctagaattgtagagctcatcaccttgctaagttatttgtaatatggcattgtttgaatccctacataatactctgaaagccctctggccaagattacaagcaacatatctgtaatcaaaaaattaagaatatttaccttattgcagcaagagcgtaaaacacttcagagtgtgggcatctcagtaagagggcattggaaaaagcttcttacagagttcagctggctgcatgattctaaggaggaattcagaaagtagaagccatttctggattagatgctttcaagaaacagagtcaatgtagtgattaggtatcttagtgtttatctagaagatgagattaaagtagggctagacacgtcgttggtaaaggagcagcaatgcctcatattagtcatttctgtgatagcagaaaggccttgtctctgtcttgtttcaaacacggccatggggtggccttgtgtctgcctagtttatttctatgagtgttttttaacatccagctgggaccatcatggcctagctagctgccagctgccagctatcagcagagctatttttcacgttctcaatgctgtcgctgaaatttttatcccaaacttcaatacccattcacaaaatattaggaaaactgtttttttcatttttcttagatatgattttggttgtttgtttgtttttgagacggagtttcgctcttgttgcccaggctggagtgcggtggcgcgatctcggctcaccgcaacctacacctcccaggttcaagcgattctcctgcctcagccttccaagtagctgggattacaggcgcccaccaccatgcccagctaattttgtatttttagtagagatggggtttctccacgttggtcaagctggtctcgaactcccgacctcaggtgatcaggctgcctcggcctcccaaagtcctgggattacaggcgtgagccactgcacccagccagatgtgatcttttaaaaattcccaatagactaacatattctttctgctttttaagttgtttggctttttaacaaattctttgaaagactcgtttacaatgatctctgccacgagtgattgtgaagctatacattaggaatgattgctaaagatttatcaactttctttgcctccctttttaattaagcaaattctgtcagaatacttatgtaagcatcacatctcttgaggttatttcaggctaatatacaacattgtggttccgaataaaataattgagacataagagatagtataaagtcttgaatatgagccaactttcttttctgagagaatatttgagtgaaaagtctcatgtactcagtagctcatgctgaaattagggaagcattttagagatttgaatttcacctcttgtcctcagttgtattagttacacttaaagagagagacaaagagacatagatgtttcagttacaatattcgaatgtatgcctgtatatatacagccgtaggtagagtcctttatttattcagtagatattaattgcatgccaaccattgacacaagatatatttttaaattttgaaaatctcaaactcaaatagagtttaaaactatattctagtttacttttttaaacaaatgattttttatgattgtattaaacaaatacattatttttccttacttattctacatcaaataatatctatttctagaaggcttttttccttgtcttaatgatagaaaacataaaaatcatttaatattttttaaatatccaaaaaatatgaggcaagaaagcagccacaattgtagctaccttaggaaacttaattaaaaaatttttttttatttttaattttatatgtgtataattgtacatatttatttgtgcggtacaagttatattttgcttattttttataatttcagtagttttgggggtataggtggtttttggttacatggatgagttctatagtggcgaattctgaaattttttatgtatccatttcctgagtactatatactgtacccaataaatagtcttttatcccttacctcactcccaagctccccacttagagtccccaaagtccattgtatcactccgtatgtctttgtatcctcatagcttagctcccacttacgagtgagaacatatggtatttagttttccgttcctgagttactttacttggaatagtggctgccagctccattcaagttgctgcaaaagagattcttttttatggctgagtaatattccatggtatatagataccacattttctttatccattcattggtcgatggacacttgggttggttccatatcttgcaattgcaaattgtgctgctatttttgtgctgctgctttcttttttgttatttccttttctggttttggtattagggtgatactgacttcatagaatgatttagggaggattccctctttatcttttgaaatagtttcattataattggtaccaattcttctttgaatgtctggtagaattcagctgtgaatccatctggtcctggacttttttttggcaatttttaaattactgatattcaaccttgctgctcgttactggtatgttcagggtttctttcttttttttttttttttttgagatggagttttgctctttcacctaggctttagtgctgtggcatgatcttggctcactgcaacctccaccttccagtttcaagtaattctcctgcctcagcctcccaagtagctgagattacaggtgcccaccaccacgcccagctaatttttgtatttttagtagagtcggagtttcactgtgttggccaggcaggtctcgaactcctgacctagtgatccacctgcctcagcctcccaaagtgctaaaatcacagacgtgagccaccgcgcccagccaaagcgttcagggtttctatttcttcttgatttaaactaggagggttgtgtgtttccaggaatgtatccatttcctctagattttctagtttgtgtgcataaaggtgttcatagtagtagtgaatgatcttttgtatttttgtgatgtaggttgtagtgtttccagtttcatttctacttgagcttatttgaatcttctctcttctttccttggttaatcttgctaatggtctatcaattttgtttatcttttcaaagaactatttgtttcatttatattttgtatttttttgtttcaacttcatttagttctgctttgatctttgttatttcttttcttctgctggatttgagtttagtttgttcttgtttctctagttccttgaaatgtgacattaggttgtcaatttgtgctctttcagaatttttgatgtagtatttaacactatgaactttcctcttagcactgtttttgctgtatctcagaggttttgataaattgtgtcactattaatcatttcaaaaaatattttaatttccatctcaatttcattgttaaccccaaaatcattcaagagcagatttcttaatttccatgtgtttgtatagttttgagggttccttttggagttgatttttagttttattccactgtggtctgagaagatacttgatatgattttgattttcctaaatttattaagactttgtggtctcttgtatgacctgtcttggagaatggtccatctgctgataagaatgtatattctataattgttaggaagaatgttctgtaaatatctgttaagtccatttgttctagggtgtaatttaagtccattgtttctttgttaagtttttgtttcagtgacctgtctagtgctgtaaatggagtattgaagtcccccactattattgcattgctgtctatctcatttcttaggtctagtactattgttttataaagctaggagcaccagtgttaggtgcatataaattgagtactgtagtaaatatcttcttgttggactaatccttttatcattatacaatgtctttctttatcttttatttacggttattgctttaaagcccattttgtctgatataagaatagctactcctgcttgcttttggttcccatttgcatggagtatctttttccgtccttttaccacaagtgatattttgatacaagcatataatatataatgatcaaatcagagtgattgcagtatctatcaccttaaatatttatccattttaaattttaaaaggaaagctatattcagaaatcactttttcttgtaactaattcctgttcttcataaagcagaaatttcatagtttgatatagttgtcttaacatttaatgaatattttcaagcaaagtatatacaatggagaataatgctcagctgcaaaagtcacctataataaatctgatttttccatttacaaacaaaagaattcccaaagtttatccattttggtagaacacgaattcactctgttgagtttggagctcttgtgcggaaaaccttggacctgcaatttagttagcatattcaaagttttaaaattatggagatgtagtcaagaataggacttgataactattatcccactgatacgctatttaaataagttgggatttaagtacttatttgatttccttaaatttgcttatagatgattaacatgtattgcaaattgttaccttttacagatttctattgagcactgcttaaattttattatatgatgaacacctgactagttgctacagccaaacattttttgttatgcaaatgaattttacagcttaattggaatgatgagagaattgaaaatatgggcaaatgccagagaagtgaaaagcaaaatgaagcaaaacaaaaaagaacttgtataatatataaataatccatttcaactctacagtacaccaaactcttgaaaaagtagcaagattgtttttgtgaacagccaaatcaaaaactgtagtcatttcataagtatttgctaataattataaaagattggaaattatacagttctgagcttattgaacctttgacccattgcagtgtcctcagacatttgtgatacattggtagtgccatttaattttaaaaatccacctctacattagagattatagtaacccctcatttacctatctggaaataagagtgggaaagataatattagagtaaatggacagactatttagagtttatgtattaataaaagagaaattgcatgtacaaacatgttattttctaggtaactaaaacctagtcctttaataaagcactgaaaaaaattttatcgtaactattttaatgagaacttttcttgaatatcttctgttttgcttcattgagcagcgcataatatctaaccaacaaatttatagtgctttgtagttcacagcatttttaccatataaaatatctcgtttagtttctccaacaaagctatgagttaggtggtattattatatccatgtttcaaggatgataaatcttagtgacccatctcattttccaaggatcacacaaccagtagtagtgaattaggaacgaaacctaagacttctgattctaaatcacaatgtaaattaacttttcttaattttcaggggtgtcgttatcacatcaatttttgctctgtttagtgatacagtgttatatgaggaacatgaaattcaaagcaccctttcttcagttgagacccagttgaagtggttaatttgcttttagaagctagactgtaagataaatacatacctttaagtattaaagctaactcaaatcactgagatacttacaccatgagaagagagtggaacctaagtcaactggtagaaacatagaaacagcaaactttgatctctctttatcctcattctgaggggcaatatgcttactgagtggaaagatgggcatacccccagcagtatttaaatcaatccctaatctatcactatctctccttttctctctatctcagcacatataggtgatttcctataaattaaatggtgtaggatgagatttcatcccatgttgaaaggtcatttcattgataaatgactaagattaccacatttctcagttttaagtttttcatgttcattgtctcctattgctactttctgttatcagaatgattacttctcattgcttttagtattctgtctttgtagggttacagaaacttcacagggaaaccagaagatcaaatatattactcactagtctcttagaatatttaatttttagtgtttaggttctgatgtcaggacaggaaaatatcttccgtgagtgatgacttccaagggtggttttcctgactaatcagaggcattattttttgtttgcttttgggttcaagactgatttttaataaataaaaaagttacatttattgatatgctagtaaatatttacatcatgcattctggataaaaacattgaaagccttgatttgacttgatgtcagacacaatagacatagtctcaagagcactgatgatagttaaattaggaagtgatgaattcttactatatattatcttttgttcttagcacagtttattttatatttataaaatttaatttatattaatggttatgtttaataaccgattagcaaaattactgaaatgtgacaataatatctctattcctgtttctttcctgctttatccttttaaaatatattatttataagtatattttaaatttataaaagctacattgtgctataaatcttgtttcttagcttttctaacattcataattgtgttttaaagatccacccatggccgggcgcagtggctcatgcctgcaatcccagcacattgggaggccaagatgggcagatcatctgaggtcaggagttcaaggcagcctggccaacatggtgaaatacaaaatacaaaaattacccgggtgtggtggtgcgagcctgtaatcccagctaccgggaggctgaggcaggagaatcacttgaacccaggaggcaaaggttgcagtgagccaagatctcaccactgcattccagccagggcaacaacagtgaaactccatctaaaaaaaaaaaagaaaaaaatccatccacattgctctacatatacccttatccatttctttcacatacatacccatgttggcctcaattccccacaatgcagcaacaaactttcttgtacttccttatgaccttaagaatgtgagagaaacttctccggtatacactggtgagggaatatgatcagcagggttttttgtttgtttttctgtgttttgctttttaacttatgcccacctttctgttggcagtcagcagccacatctgaagttatagctctctgatttagacaaggcttattcttccctttgttacaacctagtccctatagggacctgaatttgtgaccctagtctatgagattactttttaaatacagtttggttcaggatttataaaagcctaataaggctgggtgtggtggctcacacctgtaattccagcgctttgggaggctgggatgggcagatcactggagtccaggagtttgagaccagcctgggcaacatggcaaaaccccgtctctacataaaaatgtatgtactcagtagtactactcagtagtagtactgagtagctactcaggaggctgaggtgggaggattgcctaggaagtcgaggctgcagtgagccgagatcttgccactgctctcccgcctgggtgacagagtgagaccctgtctcaaaagaaaaaataagcctaataaaatgattgcacgcctggaaaacctacataggctccttcaagtcccatatatatataaagtcatccatggtatgtagttcacattgaagtcaagttgggggaaaagaaacttatttatctctttctcttttcctttattcaagtagcaattttcatttaattttattcaattcagaaatatttactgaactcctcttattaggaagcactagactggatataaagaaaacatcgtacaaggcatagaggactcagtcctgccttgcgaagggcacatagtctgactggaaagacacatgctgacagggtagactgtgttaggaataatgctcaaaatcctgaggacattgaacactcgaacaaaggattcttagcaaagcaattttacttctgcacagaggggtgcctccttggccagttgccatgagagcacacctgaacaaaggggcatgagagcctttattcctgacgcaagtcctgcccctgtaccctttccccccattggctggggttgggtcgtacaatctaaactaatcccagttggctaaacatttgatttttttagatagggtgggcacgtaaaatcaagtggagaggaaggggaaggggcgtctgtaatgagctagaaagttagtcctctttccaaataaggaaatgaatgtgagctggtactgaggtgtgcctgggcatctaacaaaggtaaaaaggaaaaaggagaaaaatcagggggtactatgaattaaagaataaaagattgatcagattatttgaagagaaacctcatcatatcccacaactggaagaaacaatttgatggcaagtttctcttcgtcgtttaccagctcaaaatctcaactatcaaaggcaagaaaaatacacacacacacacacacacacacacacacacacacacacacacacacccctctgcctttttctgtatggccaaagccttcagtccagctgaccacttcccactccagttaccatgttagcctcccaacttgtatctctgcacccttctgataaagcctccacaatgcaaaacacgaatcgtatcatatggctcttcttctctaaacacttccatctactctgtggttttagaagagaatgtaatagtcccacattacaaggtcttaataaattgcattcttgcagctctgtatcattacttgtaaacactgtagtctagatagccaggacacactgcatttcttttttaaggctcgatacctcttgccattttgcacgtagttttccttctgtctgaaatgccctttttccacctggcgcttgaatggccccttctgaaaacttcctagtcgtctttcaaaataaattcaaatgttagcttttgtgggtaacctattgacctctccaggctgagttaagctgttcccccgaggtgtcttgttgaaatcattattttttcctaaaatctctgttctaatttacttacatgtctgtgaatgcttagaggttacgaacttcagttttgtaagcttagtaactggcacaaagtctggcacagagtagcacctgaacaattatttttctggaataaataaagtaatggtttcattgaaatgattcgcattaaattaatgattagcattaaactacaacgtgtatatgaaacattccagttaggttgggttcattccattcctatttaaagagtttgtagtttctggctcttttccaactctgattcttcagactagaaatgcaatttctgctaatgtatttattttaaccaaacccgacatcaatcaagttatttgtattcctcataaggtaagcataggaatttacagtgatacaaaaacgcagctattatctcttataggcactggtaaagcttttgtgactagtgctactatactggtaaggtattgctgcttgtaatgaactaaatatttcagtggcttaacacaataggagttcttttcttgctcacatgacaacccagcgtatgttttcctagtcaagcagctttcttacatatgttattgcagaaacctaggtcctgttcatcttcttcctctgcctgccattcccttggtagcttttctctgctcgggtttcgcaagaggatgaaatcctattgaaaatgatctgagggtctattatgttctcaagaatggtacatatctagtctatgataaatgctcaggtaactgattaggtgtaatagatatcttaggattttgtcatgaacaatcagcatcaacaccacctggaaaattgttaaaaatgcaaattattgggctccacccagtatctactaaatccagaactccggggctaccatgcagcaattagcaaggtctccaggtgattctgttgatcctaaagtatgagaacaactgccctagggcgttaggacttaattctctcctcagtaagttgtaaagatttgccgtaggacctaagagtcttctgcttccagcaatagaaaggaaaaaaaatgtggaaacctcactaaatttttcaaagcctcagccccaaactgacaaacaacacttctgctcacattctgctggctataaattatcgtatagctagctgcccagtgaagtggaaccagctcaggacggcctactgttatattgccaggcattttttgagccacttgatgttatcttcttggtaatttaaatttaaccgtggtaggaatatttacaccacagaaattggcaaacactaaaaacaaggtgtttttaaacaccctgagatcagagatccagttgatatacatctaccagcacaccactggccatatacaggcttgccttatgccacggggagctctgcagctgaagtagcccttcaaacttgtcctgctttgagccaaattaggcctctatactttcaccttcatcagtcactgaatgagggctgcctggggaaaggcatgaacttggacaaggcagctctctgcagctcaggcagtccctgaagggactgacagttgaagaatgtctactgacatcatttccatcatctagaacaagagtctttctttgaagggggctctgagtagcatattcccgtgtccactgcagcccctccctttaagagactctgatataattgactgggggtgagccagtacattaggattttcctaaagttatctggataattttagtatgcaaccacaatagatactcttcaagaattaagctagttgctgagagggaactgttttttgttggtttgttttcactaatgtttgcactctacttcctttaaataaaattatgcctggagaaagggtttttgtatggagcaattgataaatatttgtagggtggttggctaaaataattataattcctttaaaagaaattctacccactaaagttaatttagaagtaaaatataatagaaatccaataatatattcaccaaatggattaagatgttcatgaattatcttcaaagtgttaatcgaataagtaatgtgtatgcttttctgttaaagaggaagttagaagatctgagctctgagtggaaggcggtaaaccgtttacttcaagagctgagggcaaagcagcctgacctagctcctggactgaccactattggagcctgtaagtatactggatcccattctctttggctctagctatttgttcaaaagtgcaactatgaagtgatgactgggtgagagagaaaatttgtttcaattctaaagatagagataaacctttgtgttattgactgtgcaaaaagtcttagagtacattccttggaaattgactctgattcaaagtgttgcatgacaacgggatatggggagtgttctctggagatacacccacaaggaagagaagagcacaagggagattgtgggagagtctgaaatgtgatttgtctgcagcagaggcctaagccagtctcgcaggagccctacatctgggctggctgtgcagagctgtcctgaattgcaggcagtgggcctggcccttgtattcctgatccagccagccattggccaggggctggctgctgcctgagagtggaaggacaacttggacaagttttctgaggccgaaggcaattcttagtaaggaacaccattaacaaccaatattcctagcatccagggatgtgtgcattgttcctgaagagggacaagtatgtctacaaaaatcacagaaaccacagaaacacacacagtcctactagcacctctccctgtcccatttgcaaacaatttaagagctctcccatttttagttcaagaaaaagaaaaatggattgggaggaccacaagctgacttgggggaggaatatttcctcatttagctgtagttttaacttttgttttcactgcatattttcagtctattttattttctttcctcttcagttgttgatagaaggtattcataaattctcatggcaatgttaatgctggctttgactctcaggggaaagaggccagaaaacttctttgctgtaccattccataattaggcagaactaaaaacatctttgggtgttgttttttgtttttgtttttttttttgccttgtctgcttttcaaagatcaaatgattgaagcattaaagcatggtgactggttcttcaggtaaagttgatttttattttatgtcaagtagaaaaatactgaactggaagaatcacagctggggtagcacaatcataattcattagaaggcataaatagtgcttggattaaaagaagccctacaatctggggacagtgcatctcatgtgccctctgggattactcggcagtcatcagagttagatttaacgactttggagacttaagcattatggttttttttttttgtcaatctgggacactgaaattgctgtatcagggttatactcaactgtgtcaggtttatttgtttttatgagctgtaatttttggttccctcagcgcatatgcatagtttgttcctatgttatcatttattggtgtctgttttctggctgtctctggtaggttcagcctcagactctgtaactccatgaagagattatgttccaatgatgttttataagtttgttaaactctgaactcatgagtttatgtcccatataagccacgttacacatggtaggaaggctccaaaaccagggcgccgaaatccatttaacgtgtaacttacctaaatgtaacaatgtttataagaaaaatacattggaagttccagttttgacttccagcaacatatataattcatccactttatttattaacttccatgtgttgagcatcatactggtgctgcgagtacagcatagaataaaagtctctcctttcataaaacatatattgtaattgaaagagaaagacaataaactaatgaagaaaatatatactgtctcaataattataagtgctgtagagtgtagtctacagattgatgtcaatgggtatttgttagacacacagaatctgaggcccctatcctagacccactgaatcacaatctgcattttaatagaatccccaggtgaatcctgtgcacactgacatttgagaaacaccattacagagaacaactaagcagggagatgggatgagggtattattgtctatagtgtggtcagggaagcttgtctgttaagagaacatcagaaaactgatgtaagtgaggaagtgagcctggtgtatttctgggaaaattattccaggcagggagagaaaagactgagcaacgatactgaagtaggaacaagatgacggaatattaaggagatcagtgagactagaggagtgggtcaggggaagtgtgatggaagccatgagagatactcatctttcatagcactgccctacttccttctccccaacatgagggtctcatcaccccccaccactcttgtcttctcctatgtcctccacattgctgccagtatggagagtctgggaatgccctcagctcaaagctgtttggtgatagctggcagagttgtggtagtagctaaaaaagaattaagggaaagaggaattttctcaaaagcaggtgcttttcatcctctttagcaaaccgaaacagatctgagcattaagtcaagatgttaaatacacaaatgttgaatgaaaaaaaaaacaaaaggtagtcatttaaattcagagctgcttttattaaaataagattttcttttttctttactgtggtagttcaaatatcagaataaagaattgtttctattcccgacttcctgacttgcaggaagttaatcagaaataaatgcaatataaaaaaagaaaatctaatttgtattatgcttcttgtatatgtttattatttcatgtactgtattacaatgtaatagaatttataattcattatagcagattgtttccattgcattcctactattaaatatgtagaagctacacatatacttgtagctttaacatatatgtctttatcctcaaaataactgcaaagaacatatagataatttttaaagattaaggagcctgaggtttagaggggagatagctagattaaggccacacagctagaaagcaagcaagcaagggtttcagtccacatgtcaagctccacagcctgtgttttgttttgtggctgtgctttacactatctctctgtccaagaacctaatggaaaattacagatacagatgcagctggccagcagttaatataatttaactcaatcttaaatttatctggagtaaaagtgatacaagtttccgtgttttttcttttctttctttcttttttctttgtgtgtgtgtgtgtgtgtgtgtgtgtgacagaatcttgctctgttgcccaggctggagtgcagtggtgcgatctcggtttactacaacctctgcctttcaggttcaagcgattctcctgcctcagcctcccaagtagctgggatacaggtgcgcaccaccatgcccagctaatttttgtagttttagtaaagacggggttgctccatgttgatcaggctggtcttaaactcctgacctcaagtgatccgcctgcctcagcctctcaaagtgctgggattacaggcatgagccaccttgactggcctgtttctgtgttttttctacttaagaagtagaaaaaattggttcactctatttgaatttcttagaaccatagaaatccaaacttggaataattattgcaattattatctagttgagtattcttcttttatagatgtagaagctgaggcctaaagttgcttgttttgttttatgaacactaaaccaaactaccttgtggctgcttacttaaattataaattataatggggtggccttgcctgagctgtataaattgttttaattatcaggacaaatcaacatactggaaaaaaaaagcaaaacttgcaattgttgttgcttagacacctgtccatatcagtttctattgttgcatagaagcaccccaaaacttaacagttcaaaacgagtgatttattgctcataattctgtgtgtctgaagtttgctctgtgattagctggatagttattctgatggtcttgcttggtgttacttatgtggatgcagttatctagcaagtgaacaggagctagatggtctaaaatgcactctctcagatatctgacagctggctgttggttgcagaaccttgattcttcataaggccactcatcatcctgtaggctagattaggcttcattacatggtattctcagggcagttttccaagagagggcgggtggaagctacaagaccttctgatgcctaggctttgaaacgtgtaggttacttctgctaagttatattggtcaaagcacctcaaaagatcagcccagattcaagagatgaggaaattacttcatctcgtgaaaggaggagatgccacatcgcatatcaaaggggtatgcatattggggatagaaggttttattgtcaccgtatttatacacaaatcactacattggggaaaaggagggaaactggagatcaaaagtgttggtcttaatccaacttaattctcaaaaattaccatgcgttagaaccacccagttcttcgcaaagtatagattactgggcttcaaccccagagtttctgatttactagctctggggtgagacctgcatctctctctctctctttttttttgagactgagtcttgctctgtcacccaggctggagtgcagtggtgcaatctcggctcacagcaacctctgcctcctgggttgaagcggttctcctgcctcagcctcctgagtagctaggattataggcacccgccaccacgcctggctaatttttgtatttttagtagagacagggtttcaccatgttggtcaggctggtctcgaactcctgacctcaggtgatccacctgcctcagcctcccatagtgctgggattacaggcgtgagccactgtgcccagccaagacttgcatctctgaaaagttcctaggttatgctgatgctggcctatgctttgagaactactaccacagacatacagtgagtggggaagaataaattcatcccttctgctgtgtgcagcaaggagtgggattccaatgagatccagtgctgtgaatgctaaagggaaatccatcttattttagcacctctactccccatctccccaccccgaggatgttatagcttagaagttcaaggagatggacaacacactaaaccaggcagtatttgccctgcagagctgttcagtgttcctggatgagacctctgagaagaaaagccataagttcctctagagactttcacaatcatttaggtagacaggactttgcatgggtctgaaggcttgcatggcagatggaggcaaagagccagcaaatctggttgtaaatgtcaatgtgaatcctttcttatccacaagctgctgggcctgagaacattaatgttctacaatacccgatttagcatttttgaaagaaattgcatatagacatgcttaatgtgaagactccaaatcaggatatttgattcaaatgtctcttggtaataactatggaatgaataacccattgtatatggacatatagaagagccagttaacagagttttctttttttttttttttttttttttttttttttttgagacggagtctcactctgtcgcccaggctggagtgcagtggcgcgatctcggctcactgcaagctccgcctcccgggttcacgccattctcctgcctcagcctcccccgtagctgggactacaggcgcccgccaccacgcccggctaatttttttgtgttttttagtagagacggggtttcactgtgttagccaggatggtctcgatctcctgacctcgtgatccgcccgcctcggccttccaaagtgctgggattacaggcgtgagccaccgcgcccggcccagagttttctagttgattaaacactggtaaaatcatctcttcctgtaattaagtttggagagagcaagtctcaagtgtaattaggaaagcacagtattggaggtcaagaagcctaaattctgatatctcagttgtgctaccaactatataagggatcaacagactgtttctgcaaaggaccgatactagatattttctgctttatgggtcatgtggtcaactctgtcattgtatactaaaagccacagacaatacctaaataaagggacatggctgtgctccagtgacactttatttacagaaacgaggcaggtaagatagatttgacccttagtgggctacccatttccccttagcactcagccttcctataaaccatgaagcgtctaactacaagtacctgtgagtcttcctgagtcctttctctgcctgtaggagtagctctcccacttgcagagcaggctggaagctggggaggagattatctctggaatagcacttaaccaatggacaaaagctgggggataaaggtgttggtcttcatagttttcatactgctatgaagaaatacccgagactggataatttatacaggaaaaagaagtttaatggactcacagttccacatggctggagaggcctcacaatcatggcagaaggcgaaggaagagcagaggcacttcttacatgacagcaggcaagagagcatgtgcagggaaactgctctttataaaaccatcagatctcatgagacttattcactatcaggagaacagcacaggaaaaccccacccccatgattcagttacctcccacatggtccctcccacaacacgtggggattattggagttacaattcaagatgagatttgggtgagaacacagccaaaccatatcaataaatatcccaccttcttctccccttgggtaggacacctccaatgcatgttccacactaaaaatctccagtgaattgggcagttgaccacaatgataagcatacttattagcatgcctcgtataggcttccttccgatgtgtaggctttcttcccattttggcagaatctggacccaaccccacatctcctgagtttgatttcagtcctcttcagtattctcatatatctcaactttgttccctgctgagatacaactgacagatatatatgtatcttcagctctgcagctctatcttctcttctaccatggctttctgggatcagctcccaattgaattatttgtatttaaatccttgtctcagggtctacttctgagcaaacctaaattaatacaagtcttagaattagtgccacagttataccttttgagtaagttatgttgcaattcccattttatagatgagataaccaagggtcagaaaggttaaataatttgtccaaggttacagagctagtcagtgacagagtgggtattcaaaaataagtctctatgattccagagcttatgctattaatcagtgcaccatgtatcaagcagtgatttagttatcttcatttgaattttttgaagtctctatttaaattgaatatcaaatcctcacatataaggttatttatacctttttatttgttttatttatttatttatttttgcttaacttttttttattatactttaagttttagggtacatgtgcacaatgtgcaggtctgttacatatatatacatgtgccatgttggtgtgctgcacccattaactcgtcattgaacattaggtatatctcctaatgctatccctcccccctccccccaccccacagcaggccccagtgtgtgatgttccccttcctgtgaccatgtgttctcattgttcaattcccacctgtgagtgagaatatgcggtgtttggttttttgtccttgcgatagtttgctgagaatgatggtttacagcttcatccatatccctacaaaggacatgaactcatcattttttatggctgcatagtattccatggtgatttatacattttaatttgaacttcactcacctctacaaagttaaataaagcattccatttccatttcaataatactttaaatatctaggcagttaaagcatgaggttacttggcacttaaatgtactcttgtcatactacttttgttggcttaaattgcaaaaaaaaaaaatggttaatttattgtgacaataccctacatttatctgcagtgatcattttttttgtgaaaatggccttcgtttatctgcagcaaaggaaaaagaggatggcaattagttcttgcattcttattcctctcttgggtcctgatccttctcattaatagaaacatggcaggggaggggtatataacccacaccctttcctgttgtggttatgtttccactgttgattctgcttcaggtgaacctttaggattaggcaaataaatttccgtgaggccaaatctttttcttcctcattaacagatgatttctctgctaaaaacacttacgacatggctatactattgccggttttatagttacaggctctaaaccttgaaaacttcctcaaagtctaatacgtcaggagcaagcttttgtacaaaaaatgtgaagacccttaatcagttccaataacaaaataaatccattttaaaccctatcccaagatactgcaaggccttggagcagctggagagactccttaactcttgacattaattaattaatttaaaaattcatatttgtatgtatcagtgaggtaagagtgcttgaaatataatgagatgtgtcacactgtagaaaggggagtgacaacagaaagccctggctggtgaggccccagcacttctcacactcatcagaaggaagtctttccatgaaggcagtagggggtccctggtcccaggccaggtccttcaacaatgctcactggttaacaggaaaggcactacagtggcatcattgttaacatccaagacagtgatagaatgtgaaacttctactgtttagtatttagtattcagcatttagatgttaattatccattttgtgatgaagttccctttcttctccctctcttaaccttttggtagttttattgcatggttaccatttccagttagggttgtgctttggggtctgaactgatgaaggaagagaaactctagttcatcatttctaggaaaaagagaaggctaacatcaattctgatgattagagattttttgattacctatgtcctgcattttaacagaaataaaatgttaattacagtaaacttactttaaccttcttatgctatttaacactcttcaagaaaggacttttgcttgaaatcactacagagtataccataatcttgactgtcatactctgaccaagaaaccagaactatttaggcatatttatgagagtaagtaccctaccgctcaaaatggaaggcttcaacatgtattcctaatatttcctaaaacttcactgaatagttttaaaattgaatataactttaccttcagagagaaacaagatttcgaaaggaaattgtagcagttttgtacttcaattgtcgattttaagattgtggtctgaaaagtatttgaacagtcattctttcttttccactatctcaggaaaggctctcattctattagaagcaatcttagaagcgtaactgccaactctcttcttaaaaagtgaagagcagatggagttctaccaatctgctatacttgacagtttttcaactacctaacctaagttccagttactgtctaaattatttttattcgaataggaaaaatacatttatgcttactgtacatttcgacagtgttcattctttgaggtctgttatttaatctccttcccacttttcttttctatcttaaatcagatgagtccccatggtctggcaacaaaacagctgtttctcaaatttttaacgtctctgtggccctcctcctacccttccaagtgttttccatactatttttctgttgtgggcttcagaattggatgctgttccataattactggtcttcccatgactctgtcacatcataaagtctatatatacccttttcctacgtttacatgccaaataccaggtgtgtctagctttaattcaatgactagcatatggtaggtattgcactaatattttttggtcaagtgaacatatattttacagatagatcaaatacatcaaccttcccatgtaataataataataccaagaagattaaatgatcgcgtgcttgaccagctgtttagtggcagaatctggacccaaccccacatctcctgagtttaatttcagtgctcttcagcattcttatatatctcaactttgttccctgctgagacacagctgacagatatatatatatatcttcacaatctcagtagtaagccctatttttttaagattacagtgctgatcaaagagggatattctatggcattgatgcaaatcttccaggccagatataacccctatctccttaaaccctcattcttgactgtgtcttgaaatcaaatttgagaacctctgctttacatgctaccttcctcttaaaattcataaggtttattccttctctcatcttcagtatttttatgaaaatatgttttactcttatttccaaagtgcttgccagcccatgctgagttcattagacaaacaatctaggtatcctaatatttaggtaaaattgctagcagcactaactataccagtacccacttaaattgcaatataaacctacaataggaaaaaaaaagtcaaaattatactactttcaattcctacttctggaataattatcacaccttcaaaaaaactcataattgttctccaatattaaaaaccaggaactaaattacatcactatatatatatagctatatagacatataactgtatatagtttatatatatattacatgtcactatatatggttatatatacagatagctatatctctatatagtttttatataggaaactatatatataaactcatatatatttatatataaactcatatatatataaactcatatatatttatatataaactcatatatatttatatataaactcatatatatataagagattttatatgtatatatgagagacaatattgaaataaaacaaactagccaatctccaatgtcccttcattttcccaggactcttctttattctcaaagaaatgtatgaatacacaatataaataaatgttctataatgttcattatggattataatagttttcttgtcatactgaagtgaatgggaattgtttcttcgattattagcatacttttcataactatgtgatttggtgataggcacttttgcttactaagttcagcatgatcaaaacagaactcctattatttttattgttgattcttatttctttaaggtaaaatatgcccttttcctttgaacctgcacactgtttaacaaataagcacataactcaggattgaattgtacacttcgatttgagcttttttttcaaggtcaggacccagtttcacaagaagttttattttttccaatacaactgacatccactcccaccagctgaaagacaagaaaaacttgtctaataaagctttcagattcaatttgctgcctgcatacagcttgaggaatctctggaggtcactcacagcatgtgttgcaaccccaacagggagaagtaatgaaaagattctagttaaaaagctgacactgccccttccaacctctttgaatgtgaatataataagccagtttacagacgcaaatctctatgattctggggatttccatcttgatctctgactccaaggaacatttgaatgcatggatttgtatccattatctgggtgaataaatgcttcatattgaaaaaaggggtgctttaacaacataagtctgatgtaaatcaggcaaaacaacattgtcacttcatgtttaactctcctggagggtctctaaggtctcacagtttggttctattccagtaatatataggcctatcatagccattttcaaaaataatacctgctttcatttcgattattccccctagcttttgcattgacccgaacatacctaatatttatcttagggctaacacgcattaatgccttgctctgtaccaggcattttgccaagtattctttgtgcatttttctgtttaatcttacagcagccttatgaaataggtactacattattattatttttcaccatgagaggaaatgaaagcctagagagaatggttatccaaaaacacccagctactaagtgggcacagcatggccttgaacctgagtctttataaagttcatgcctgtcttttacctttatgttaaacatactgaatcttggtcatgcagtctatgaatgaagactccatatactctaggaccaattctaccatattgtgcatgcttttgtacatattttccaaatgaaattaaacaacaatactctctcttcccctttcttttccgttttgcatgacatctaaatcttttattaaatctccgtgggtggaattgggccttaagtagtagtacctttgaagcttaatactataacctcagagttacggaagtggtttcaatatgaagaaatatatacgttcttttcttttcttttcttttctttttttggctcctctagaatagaaggcaatcaggagagaaaaagacattaagatgataggcttgattctcccacagtgttactacttagctttatttattctcccacatctgtaactgtcaattcaaggtcaaaaagccagtacagcagcagaattacaaaaagtagatctggaaaatctatagggtaccatagtccagcaccctgctgcaagtcaaaatcaattaaataaatatgtttaaacagcacttcatttaatcttaagggcaccacgactcccttggaaaattcttttttgtgttcagacctgattctctgaaagtattttctagtgttttctttgttcggtggctgtggtgaataagtggacccaattgcctacagcatgaaatcgtagaaatgaatatgggctggaacttcaatcaatcacacaaaccagaaacatagagttcatcacctcttctggaaagcgtccccttcggccgtcaaaagggtagagtttcctccaacatatgttcatacttccctttgcctcccatctgcaatttcaaccagtctgttgctctcgccctttttaggcttcacataccggatttcttcttaggagctcacttgaaaaaagggttgtatgctttaaaaatactaaaagtcactggactagatgataataaaatttctgtaaaataaaaagggagttaacagaggtgttaccacttatcataatggatattgttgacctttcctctagccagtgtcccacttaagcatgcttcttggctggaatttatttttctcatctggataaatctgaagcattatagtaaaacccagtgtgagcaaggccatggatgcaagtggattgagatgaatgagtggatagacctgcgtgggcagaaataatgaggtcagcaataagccataccaagggatgcacactcaaggaataaattggaggtagcagaataactgaacaaatgatacatttgatcagactgtcacatgaatatcaactgaaacaagttatgactgtagttagtgaaccctagagtgaagaaaacaaaatattgaaatccatctgatcaaaaaataataaaattgtttacatgtatatattatctaaaatttcccttaagaatgaagattataaattcccgcagttgaggaaactgaataagaggagaatcaggacagaatcttttctcttcgtattcctagtccatttttcttctaactacagtagtgagaacaagaatttattcaccaaatcataatacattgcaattaggggatgccatttgaatcttggaagacacgatttgaggcaaataaaaaatccatatttataaagtcaattattggtttatataatttactgtttcagcgggaggtataggttagtaatgtaagtcacttcaagaaggttttggtcgaagttttgccaattttttctgtaaaaagccagatagtaaatattttgggttttacaagccagaagatctttgttgaagttactcaactctgctaatgaggtgcaaagcagccataggcagtttgtaaatgcataagtgtggctgtgttccaataaaagtgtgtttgcaagaacaggcagttggttggatttggcccacaagccgtagttcactgacccctgttttagataaatactagtcaatagattccttgtagctaataaagggaatatagattgtttaatgtgtttccctaatcttcttaaggcttcctccaggggaaaaaatatttcttatcatcagcagtgttattaatgcttactcagaacaaagaataccacttacttagcatagaatggacatttataaagccactcatggaaagaataaagagatgtgaaatacctggtacaactcttaagagtgttccactatcatttgaaaaaatgatgagtagtagttatataaaaggactcgagcctaaaacatttgttctcactttggataacgttttcctatctcagcatcaaaaaatacaaagaaaggggataactaggtcttagattttctaaattctcatgactataagtcccatatatttagatattgaagtacccttaaatatacctaagtagaagtaataatttcgatattatgggaaatctaattactgctcatagttctcgagattaaaatgttatacaccacatctcagctttctttgaaacttgaaatggcatacttgtacaaaggtagaatggtctcccaaagcagcgtcatagattagcagaaaagagctatgataatgccacttcaactgactatcatttaaataatgaattagttaggaagagttaaattatatagttacaggcagcaggagatgtcaccatcagggggataagaagccattttccagtacactatttgacttaactggtgcagttccttctttaactgtaggttactcatttgtatccttaatttatcaatatactaatctgacaaataatttattaaggattactgtgtgccctcctgtgtgttagattctagggatacaatatggatcaagataagcgtgattcctagactcctagaaagtaagaaaactaaataactgtacgtgacaaatactaggatgtagaatactagggaagaatcaggaagaatcacctcacccagtctggagtattgcaacagagcgatgtcagaggaaaaattctggaaaaaaaaaaaaaaaaggaaatttgaagatgagacttgaaggataagtaggtgtacctaggcaaacaagtaggggagagtgttccaggcaagagaaacaagtaacagttggaggcaaaatggagcctagcacgttttaaaaatatcagtatggctgaagcactgagttggggttgggaatgggtgaggagcgatgtgtcagggaggacattccagatgatgctggaaatgcatgcatgttcgcaaactgcattttaagacatgttagagaaatcaaacacattttatttgaagggtaattgaaagccactgaagcattgtagagagactagtgacatgagcatatttgggttttagagggattactctggctgaagaataggtaactgattggataagagcaactttggaggctattccagtggttcaggtgatagataataatgacctaaactaaagaagtaataaagggaatggagacaaagtagacagattcaagtgatacttggcacgtggaaacaacaggccctggtaactgattggacataaaatggagagatacagagaacgcgaatagaacacccaggcatttggcttgataaaccgagtagaccgtggtagaaattactaaactatggagtattttagggttcaggggaactgtgagttcaattttagacatctagttttgcaaggccactgaggtaactgagcatatgagtcaggagagaagtttaggctaaaaatatggatgccagagttaaccagcgttatgataaaacaaagctgaagtctcgagggtaagaacacctaaacatctaggctggagaaggcagcaggtaaaaagtaaaaggagaggccaggcacggtggctcacgcctgtaatcccaacactttggggggccgaggtgggtggatcacctgaggtcgggagtttgagaccagcctgaccaacatggagaaaccgtgtctctactaaaaatacaaaatcagccaggcatggtggcgcatgcctgtaatcccagctactcgggaggctgaggcaggagaatcgcttgaacccaggaggtggaggttgcggtgagccaagattgtgccattgcgctccagcctgggcaacaagagtgaaactccgtctcaaaaaataaaaagaaagagagagagagagagagagagagaaacagagaaagagagagaggaagacaaagaaaggaaggaagggagggagggagggagggagggagggaaagaaaagaaaaggagaaaaattcaggagaatggttacttccagggagatggaggcgattgtgctgtggggaacacaagggtggggtcaaggtattagcagtattctatttcttgattggggttgtatttacataaagtgttgctttataattattcttcacactttatgtgtacgttctatgtaatcatctatagataagacagatttcactgtaaaagaaaataaaagcttccaaaagattatcatcacaattgtaacagattcccctggtgcctggagtcacacgccattttcctgcactgcagttgcagctgcagtggacagccctgtgtgagttcagacttgcctttagctgacagcatcccatgtcaagggaatggctcccatttttctactttctatctaagggacttctctgacatcccaggagcccacagattttgtgagctttctcacccttgaagttttagtgagtgagcaaccttcaaccaatggagatgggagcccatggatatatttttaaccactattccttccgggggcaaggggaattctctgtgattctcaggaacatacaaaagttctgtcaaaatacagtccccatggtccataagcattaccttgatgataatacatttgattggcatttcctccccctctgtctcactcttttggtttttcattcttgcttcctagggatcagcttccaaatgagctatctgtacccaagtcctcatccaggccctgttttcaggggacccaaagacaacaataagaaaaatggaactgaaagaggagaagactttaaggcatgaaaaaagttcctctgtattccatactgcatatttaactgcctactcaacagttccacttagatgtctcaaaaataatctcatgatcttttactgctatgaaatgcatgaccttcccctgatatattcctttcttcaggttttgtagcaccacttagctatccagtaacaaaatcttgggggtcattcttaaaaccttcccacctcacccctgctggacatccaccactaagttcagttgatttttttgctcctaaatatttcttggttcagctttcatttttagatttatcctgcatacccctgtacaatctcatcatctctttcctggactgttacagtagtcttatattaggatgatcatagtcttgatttgcctagagaaaacatgctttatgtcattgcctcagagtgactaatagtcccacctttcacttgtaacactatgcaggttattgggttaaataatactgtcatccaaacctaatctctcctcattcatttcttctctcctatgcatcttagctgtgtgaaaattcaaaatataaatttgatgacagacagaactctgtttaaaatgctccagtaccttaccatttatctcaaaataaaaatttcaaaaaaagaaatgatatcccacaggatcttgtatagtgtgaccctttccatttcatcatccttataccagatactgtgaactacttactctcttatctccacattgacctccctcctagttttgttttgcttatgaaagtgcttattttctgttttttaaagccattgcacatattggtctctctgattgagacactatccttttgaatttttgacctcatacctactcacttttcaggtctcagctcaaatgttatactcaggaaagacgctccttacctcccaaactaggttagtgtaaatggcactatttatactcctcttccagagcacacaccaaatcttatatttatttgtgggacaatttgaattcatgttgttccccctactcaattgtgagcttcttgaggacatactctgcctcctccttacctagctttattgaagtataattgagaaataaaaactgtatgtattcaaggtatacaacatgatgattttatatgactatattgtgagatgattaccacaatcaaattaattaatacatctagcacaagaaatagttactattgtgtgtgtgttgggggggggggatgaggacacttaagatccagtcttgtagcaaatttcaagtaaacagtaaagtattattaactatagtaaccataatgtacattagatccccagacatcttataactgaaagtttgtgccctttgaccaatgatatggtttggctgtgtccccacccaaatctcaccttgaattgtaatccctgtaattcccatgtgttgtgggagggacccagggggaagtaattgaatcatgggtttgtttccccccatgctgttgtcgtgatagtgaatgagttctcatgagatctgatggttttataagcatctggcatttcccttgctggcactcattctctctcctatcaccctgtgaaaaggtgccttcctccatgattgtaagtttccggaggcctctgaagccatgcggaactgtgagtctattaaacctcttttctttataaattacccggtcttgggtatttcttcatagcagcatgagaacggactaatacagtaaattggtactgcagagagtggggtattgctgtaaatatacctgaaaatgtggaagtgacttggaactgggtaagaggcacaggttggaacagtttggagggctagaagatgacaggaaaatgtgggaaaatttgaaacttcctagagacttgttgaatggttttgaccaaaatgccgatggtgatgtggacgatgaagtccaggctgaggtggtctcagatggagattaggaacttcttgggaactggagcaaaggacactgttgctaagctttagcaaagagactggcagcattttcccctggcctagagatctgtggaaatttgaacttgagagagatgatctgaaattggaactttgttttaaagggaagcagagcatcaaagtttggaaaatctgcagcctaacaatgtgatagaaaagaaaaacccattttctgagaaatacaagctggctgcagaactttgcttaagtaaaggagccaaatgttaagcgccaagacaatggggaagatgtctccagggcatgtcagaggtcttaatggcagcccctcccatcacaagcccagaggcctaaaaggaaaacatggtttcacgggccaggcacagggccgtgctgctttgtggagtctcaggacttcgtgccctgcataccagctgtggctcaaagaagccaaagtacagctcaggctgttgcttcagagggtgcaggccttagtggcttacatgtggtgttgggcctggggttggacagaagtcaagaattgaggtttgcaacctctgcctagaattcagaggatgtatggaaaagcctaggtgtccaggcagaagtttgctgcaggggcagggccctcatggaaaacctctctgctgggacagtgcagaaggaaaatgtggggtcggagctccacacagagtccccactggggcactgcctagtggagctgtgagaagaggaccaccatcatccaaaccccagaatagtcagaaatgctgatagtttgaaccatgcatctagaaaagctgcagatactcagtgctagccatgatagcagctgggagggggctgtaccctgcaaagccacaagggcagagctgcccaaggccatgggagcccacctcttgcatcagcatgacctggatgtgagacatgtagtcaaaggagatcatttgggcagttcaaagtgtaatgactgccctattggatttaagacttgcatgtggcctgtaacccctttattttggccaatttctcccattcggaacaggtgtatttacccaatgcctgtaccccccattgtatcctggaagtaactaacttgttttggattttcaggctcataggcggatgggacttgctttgccttagatgaaactttggacttggacttttgggttaatgttggaatgagttaagactttgggtgactgttgggaaggcattattgtgttttgaaatgtgatgacatgagatttgggaggggccaggagcagaatgatatgttttggctgtgtccccacccaaatctcaccttgaattgtaatctccaaaatccccaggtgtcatgggagggacccagtgagaggtaattgaatcatggaggcagtttcccccatgctattctcatgatagtgggtgatttcacatgagatctgatggttttataagtgtctggcgtttcccctgctggcactcattctccctcctgccaccctgtgaagaggtgccttctgccatgattgtaagtttcctgaggcctccccagccatgcagaatggtgaatcaattaaaactgttttcttcataaattacccagtctcgggtatttcttcatagcagcatgagaacagactaatacaaccaacatcccctcttgtcgattttcattgaatccccattacctgggaatgaatgaggaaggcagaaatagaaatcagcgtattgttcaatatagaaatcctgaagttacacaagataattacgagcaagactcagtacagagaaggaacccttgagctggggatcagagtcttctggaaacaaggagtaccaaaggggagtgaaaaagagaagtggagaatgagtagtagcagtaaaagaggaagtatgtaaagaaatggaaataaagatgaaataaactgtcatcttgttccagagacaaagctagctaggggagctaaggaaatttagagggataaaaagtctcatccaaaccttcataatgagctaagggctagtttttcatagaccctagcccaacttgcaaccctctcactctcttacttttttcctggctctgttttgctttactgcctttcatataatctaaaatgatgttaaatgtatatttcctgtctcttttctatatcacaatataaattccatgaggccattgcctgtgccacatttaccactgtactcccagtgcctagaatggtgcccagatcaagtagactcccagagtgtctgttgtcaaatgattctcagtccagtgatgtttgcactacatggtgctgccacttttttttttttttttacttcattccatttggaatttggatcattttgccaactttagggtttattcctctttatttcccctgtgtttgctgaatatctgactatctatttttctcagctctcttctcctcacactttgcctccaacttcctctctgctacaaattatacttagcacaagactggagccacttttcattgattttgatgtcagtgcttgagtgacaactccatgtggagaactttcaacctcctgctgtctcgttgtttgctttgaaaaaaaaaaatactcatcttcttcctgaacccactgggtaaatttatgctcacaaaaaagacaaaacttctagaacaaaaactgtatgagcttcaaaagtattagttttcccttgattttgagactcaaaagtaccatagaaattttaaaagggggatgaagtaattttgtcattcaacccgatatattttacaatttgaatgtcagaaccatgaaatgtcttttcagtgtactatcatcctcactatttccacctataaaagaaaagcaaaaatattgtttgagaacaaaaaaatattgcagtagcggaaaaattcactttaagtctttttttggaggttgccacatcacgcctgtcttcagctcctctcactgaagattctttgttttcttgaaaccagttggtcacttccaattcttaccacctataaatcttcctggttctttatatttcactttatatgtcccttatctcctctgatttttgttccagtctttcattttttacattctttgtcatcctatatgtcagaaagaatctgccactccaaattccttaatatatttatctaccagtgtttatttgcctgtcacatgtactcttcagtaatccattgacttgaaaactttctactctgtctttcttactatagtttgcttcttgagttcaaattattaatatattaggtcaagtaattctatttttatgcacattttacctaacattcttggtaaatataattgttttttaaattgcatcacatggtgagtattaatttaagacgtaattagtattaatctactggacaagattttatttattaactgttttgccctttgctagggttctgtaatctcaccctcagtgcctttaaatagtcttacccaaggatcacctatccctcttcaatttaaattctctattgtgttagtttctgagattgcacattctctggtttggtttggtttttcagtgatctctgtggtcacttccaaccatttctacttagtttacttttttccctgttagccctcttcagtgttaatatcacctggaagttaacccattcctagtctgcattgctctatggccagcatcttggctgattggccatcacctatcctgtacttattgtcaatttttttaaattttttattgtggcaaacagcacataacggaaaatttaccatctgtctttgttcatgtatgttgctataaaggaatgccagagactgggcaatttataaagaatggaaggtttatttggctcatggttctgcaggctgtacaaaaaagcatggcaccactaccaacttctcatgagggcctcaggcttcttccattcatggtgaagggcaaaggggagctggtgtgtagagatcacatggttagagagcataaacaagagagagaggggaagtgccaggctgttatttggcaactagctcttgcagaacctaacagaatgagcagtcactcaacctgcccccaggaagggcattaagccattcaagaaggatccacccccatgaccccacacttcccgttaagccccacctccaatattgaggatcaaatttcaacatgagatttggaggggacaacatctgaactatagcattatcttaattcaaataattttactaccaattccatttattagagaatctaagattaagactactgaaactatgccaatgattatctctagttcaggcttctctcttcaattccaaactcatattttcacctgctgacaagctaccacgtagatgttccacaggtatttctaactcaggatatgtaaaattgatgttatcattattttctgaaaatctattcctcttactatattccctatttttgtgaatgacacaatctaatggactggccatgttaaaaatcaggaagtttttctggcactttctttattccttaatattaagccccacgataaattaccaatcctttcgatcttgttaagacaaataagcttgaaatttcttatctcttatttagcactgcaattttgttttctcattcattcagatagcatcttctacaaaacctcttcactagtttttctgtctctcagctcatcttgtacactgcaaatccattaaaactacactttttaacatgccaatcataatgtattagtaaaggttgtataatagttctctttctcttctaggataaaagctaaatttttcagcttggtacacaaggccgttcatggatttggtacctactagtctatctagggtatttcctacatcttccctcctctctcttgaaaaatcaagtaatactaaactatttgtaactccctaatcaccaattgctgcctttatactttaacatatattcttccttttgctagaaatacatttgtcataataggctctttggtaaacttaccattacattctcagtttataatattatttgtgtaagtaccttttttcctacttagtcctccaggggaatgcatgtgcttctctctccatattatcattttaaaatttactcctatttcagcaagtatcataatattttactgagattaattgttggcatatttatgttaccctggtgacatatttaatagttaagatgctttgggctgcaagaaagagaatgcactttcaaagtggcttcaaaaataagaataattcaactcacataactggaagttcagaggttaaagctggctccagatgaagtacaagcagagctctgtcactctttctctatgactttctttgtcctgatttttttctctgcgtcagctttgacctcctcactagttgccctccaggttccaagatgactgccagcaacaaatgggtaacataatttcttgttacagtgagagacataaacacttacctcacagattcagagatttcaccctcagataagaacaatcaaaattttaattgtgtatctactgtatcattagtatatgtattaggtattcatatatatctactattgtactaaagatgattcagaatggtttcataagctggttgatttaaacttttcttcctgaaccaagaggatgagattatcttgactggcttagaatcgaagatttaggtgaatctaaatccatctccagaactgaggatggattccgtagaaacttgaagacaattggaattctcctagaaagcagaatttcagagtgggtgtagggatatctttgaatggaagttgtttaagccaccaacaatattcactccattggggtgacactgggcccaaaggtacccagttaatatttgttcaacgaacctataggaagacaatattatctgcaagctatttataaactaaatgacaacgagaagtatttttagaaaagttaatcatatacaatttagtcattcacattgggaggctcttcctaaatttcgtttctgatccttatcttgatctttgacgcaatcatatcttggcctccatctaaaagccagtagaagcctctggccattttttaaacaattggtttaacaacattaattggaatctatatagctcaacttaaaaaaaaaaaaaagaggaactagcttatcataatacaatattgtcaaggcaagtgatacttccatgcagctattcagcatttggtgtattcttggtttctgcagacctaataaaaagagattatctcagcgtcctctaggtttaattttaaaaaacaagaaaccatgaacaatgaaaatgatttcaaaacatcttcactcacatctaaaatatgaaatagctagatcagaggttcttaataatttaatcggtgaagcataactgaaggatttagaaaaagtgcctaaactattaaaagattcttcagctgctgcttaatgttgatatcaagttattttttacactggcaaacagctaagccattccctggtcacatccacttttcagcatttagcgctcctctcaatcatcccgatcacagccccaggaatgtttcatggcatctccgcaataatagtatattactattgggtcctgaattttgaggtagtttatctttcagaaaggatatgaatagagcaataagtccaagtagagtgggctttattaatgatgcccaagattttagacgtatactataatcttcaatcaattttaacaccacttcccttaccctagttttagtctaaaccagtccaactgtgctgtagtctcagataatacaatgttagattttttttttcaagatatagaattgtcgggaaaacttgtatgtaacctataccaatctaaatttcttagcatttaactctaaagagtaaagcttttagcacttcctgtgtaatacaagggcaagtgctgatttctctgaatataattttcctttgttagcacatatgttcactgtttaataaaaataagaatgcttcaattatctccttttgtcaagggcctgagaaataaagaaatatacagagggtcccaatctaaaaatgttttgatttacaatggttcggcttaggatatttttattttacaatggtgtgaaagtaatatgcactcagtagaaatcatacttcaagtactcatacaactgttctgcttttcatgttcaatacagtattcaataaattacatgagatgttcaacacctttaataaaataggctttgtgttagatgattttgcccaactgtaggctaatgtaagtgttctgaccatgttgaaggtaggctaggctaagcaatgatgttcagtaggttaggtttattaaatgcatttttcaatttatgatgttttcaacttatgatgggtttttcaatttatgatgttttcaacgtatgatgggtttatcaggaaataatcccattgtacgttgaggagcacctgtatcaatataggcatttacacaactctcgtactgatagcggcaggaggcagagaagctctaggcagaaaagggatggtccccagcgaaaaccccaccctcaagccaaaaagcctgaaaccgcagctcaaagtgggaacttatatcccagttttcctgctcgaatgttgcctttttctaaaccacccatggccccaccccaccccatcctgtgcctataaaaaccccagactcagctggtagacaggactacagctggacatcagagagaagcagcttgacttcagagggacaacttgatggcataactttagagaagaatccggctggacttcaggggaagattacttgccacccccatccccttttcagctccccttcccactgagagccactttcatcggcagtacaatccctcacatttacaatccttcaatttgttcatgtgacctcattttccctagatgctggacaagagctcaggagccacaagtgtgaatacaaaaggccctttgcccttgctggtggagggcagctgcctcctgtgaaaagacaaatggcccactgagctgttaacgcctaagctgtccgtggatggcagagctaacagagcactgtaacacaccctctggggcttcaggggtcgcagacgcctccacctagatgctgctccagtgctcatgcactccagttcccacctcgtttgcttgcacactccctccagtgaggagttgagagcagtgggctaagtaaataaggcacccctgttgcgagttccacaaaggggtcagggaaatatcctgcttcgttactaagtaggtataaaccctttactaagttagtaattattcagtaataatacttaaatgaaagctattctgttagactaaattcagattatcaaagacacgacagaaaacagctttctcattcatgaacctattatttccttttgtaaaatatgttaaatgaaaatacagccgtcatgctaatttctaatggtagaacatattttgaaaactcctttatgtttggaagattttgctttagtgcagataatcagaatgatgtgatatactaagaaataatttttaaaatgagatgtgacatttctcataatctaaataagaaatggcaaaacattgtcctaagctaaataactcatatgaagtgataaaatattgctttctaaaggtccatgatatgtagtgatttctaatgtgtttaatagcattgatcctattgggtaattgggtggttctaacatgtaaggaaggcctccagtactaatttcatgtactgggaaactactgggcagggatgaatcccttaactcctaagtaagactatcagatcatataaatctgctttttgatttgcaaagactcttaggcatacctcttgagaatattaaacatctactaaattatatgtaaagcatttcagtctaagatttacaatgctcaaaggagaaagattttaaagttcagcattggaatttccataatttccttccaattgtagaattttacaattgagatagcaaataataatataaataaatatgtaagactgaaatcaacataggagtttggaaagaagactgtatgggttaactagagttgtcaacaaagacttcacagaagattgtgatcgtagacattagtaaggaataaaatgggtgcaaaaaaaagtctaagaaacaacaaggataaatttattttgtaaagagtgaaagcatattgggtattacataaagagactggctagtttgacacaatgtgtacttttggggtaagcagtgggaaatcactttctgtaagtaaagtggaagagaattcaggtattggatatggtcatataggatttttcaacctttgttttgcccccatccctatcctaccagtatcatcacagatgttggcaatattcactcacttgcctgaagatagatattcatgtcaggggctacagatatgtaaaggtgaatgaagttaaatagcaaaattcaagcacactagttctgactgtgcaccctctctcactcagaaaagcactttggaatgcgagagtactcttatattgacaacctttagttggttctaatttataaaaaaatataaaaatatttagacaatttggatattttatatctatgccacaacccattgtcaaatgattgagatatcattgtttggcaacaatgaaactgaaatcaactctaagagtaaagagtacgacttttaaagatatttggttaagagtaatgttgcaaggcagagaccaacattatagaagttctcaacctgtgtgctggatatagctaaaatttcccaggaccattgaaagaaattctcaaatccacaaccacctcaagtgttgtctgtgaatcaaaggagtgatgcattacccacaaacatgtagtagacattttttaagtgatgtagatgctactgcaattaataaatgcaaaattatattacaatattactgaattcagaataagttgattttgtcactatttttctcaatctacgcatgctagatataaagttattatatagagacgtaacatttttaatatttcagaagcatgctcatgatattgtaaaccaggcactgttaaaagatcactggattgggaattaataaacctgggatctagtcctcatttgatctcttgttggctatggtttgggggttttgggcaaactattcaaccttttctgccttggtttaattgataaatgatggtgttttcccagataaatcccttcccaacttaatattaccagatgtagcatctatggtttagaatgtacagtataaattaaccttcctgaagatcttcacaagttactataacctatattttcatggcactgaaaactaagtttttgatagcttacgtttttataaataatttacttactcatttttatcataataataaatctgattcactaatcaccaaaatatcatttttgaaaatagatgcatgaaaggatccgaacttgttatggttttatctgttcaagtcacctaattttggtagccacaggcccccattgtcaataggggaagattatccattttagcaatacagtctctgataacttcagcccatatgcccttcaattccacttttacgtcagattgaatgggaatgtgaggcccccagtagtaaactaaccctactttctctttggaaattggtctttctacctagctctttgcctctgttcacgttcttgtattccacagaaaatatatacattaggtgttaaaatcacaatgattaacaatttttaagtagaaatagttattaagtatagcataatcatgcctttgaattagtacaaaagtaggaaacagagctttagtgacttttttcattctttccaccatttacagggcaaaaatgaagaattttaccaattcaaaactatgcacatgtatagtttccaccagtatttagtagttatgtttctcaagatgtataattcctttcctttctgttttctgtagtttgataaaccctagataggagttaatgttgtttcagttaggtttattatttcttttatgtggtttaatttcatgcaataagctagagattttgtaacataacttgataaaaattttctcccttcgtatctttttgttttaaaataatggattaatatagattgtaattttacagtagaggaaatacattttacttttagttcttatctagatatcttaggaaaaaagaaacatcatttttaaggattattatttttctactaatgaaaaaaatagcatgattttccattctggactttgtaattaactttaccttggaataattgaatcttaaatataacttcattgaaaattttattttcaagtaacattttaaaatgcaaaatttgtgtgatctctactaaaaagaactctcacatcccaatgtgcttatagctacaataattggttaaaagagacaaattataaagaagatataggttgtgacattgaaattacaaaatgtggattagggaagtaagcgtgtagagttttgtatgcaatcaaagttaagttattaccagcttaaaaaacccttacgtaagatgtaaagaaaagcaaaaacctatagtagcaaaagcaaaaacctatagtagatatacaaaaggtaaaaagtaaggaatcaaagtatactactgagcaaaacagtcaaaccataaaagaagacaacaaaaaaaggcatatagaacaaaggatctacaaaacaattagaaaacaactttttaaatggcagtagtaaattcctacctatcaatatttactttgaatgtaaatggattaaattcaccagtctaaagatagagtggccaaatggattaaaacaacaagactcaactacatgctgcccataagagactcacgtcatcttttaggacacatgttgactgaaatagaagagatagaaaaagatattttggtttccatgcaaatggaaaccaaaagagaatggggatagccatacttctattagacaaaataggctttaaaaatcaaaaactaaaaagacacaaagaaggtcattaaataatgataaaaggatcaattcatcaagaaggtataacaattgtaaatatatatgcacccaacattggagtacctaaatatataaagcaaatataaagtgataaaaagaaagagacaaactacagtacaataatagtaggggacttctaccccaaattcaacaatagacagaaaatccacattaaaaaatcaataagaatgcattggactttatgctttagatcaaatagacctagcagacatatacagtacatctcatctaacagcaggagaatatacattcttatcaagtgcacaagaaacaattcttcagggtagatcatatgttaggccacaaaatgagtcctaacaaatttaacaagattgaaagcatgtattttatgtaaaacaacgccatcatggaaaaagtactagtgtaaacaaggtttaaatatgatttactgattgtttaaaaaggaattatcttagccctgatctgatgggatttcccctttgtaagcagcaaaaataagttcataatgaagcaactgtaataatacagcttcacagatctttctgaataaacagagttggatatgtttctacttcagaaaccatttactgtgggctcacagcttttccatacactctttacactcttaattttaaacccattcatcaaaaggattaagacaatgagattcaagtccaagacaataggaagtatgtgcatcaaaactgtcatgctaatgctctgaggaacattgttatttcaatagcataatttaaaaccactgaaaccatgttttatttatgattacctttcatacgttcaaaaagaatttgagatggtttggcagggatgtcttaaagaaacaaacaccaaatttttatttgttgtgcttctaacaagcaatttttcctacgtaagtgttacctgttttctccccttgattttgatctcttttgtatggttggtagttgtcgcacttctgggcatagtatggttttctacaagttaaataaaaacataaattgattttgatgtagctagttccactatttcagttagtgtgttttccatacctgcaattcataacatgtttactgacccagaacgttaaaactcaagtttagttcaatacagtcacttcaaaccaacttaagatagcagttacatttccaaggtcattatgaagacggagttcaagacttcagcagttgaatttgtcaagctcatgggtcttttagttacaggaagtgtgcatatttcacataagaaacagcaactctgatgatacattgaaactcaaatatacccaaggagtgtaaaactactttataagcccttaaacaataaatatgccaacaatcctctgcatactttttgtcattttttagagcattcaattgaattatataacatgtgataccaataaataattaactttttatttatttatttagagaatgattcttgctttgtctcccaggctggagtgcaatggcatgatctcagctcactgcaacctccacctcttagtttcaagtgattctcctgcctcagcctcccaagtagctgggattacagccatgcaccaccacgcctggctaattttgtacttttagtagagacagggtttcaccataatgatcaggctggccttgaactccggacctcaggtgttctaccacctcagcctcccaaagtgctggtattacaggcatgagccacagcgcctggcttataattaactttaaaaaatattctactatcgaatgcctgaaaaaatcatattacttctatgtattaaaaacaaactattacgtaaatagaccagagatacggtgtcagagatgagattccttggcaacagtctctgagacaaaaagttgcacacagaaagtattttgagaagtattgttgctatttataaggaagtgaaggaggcagtattgggcagagagaaaagctcatccacactgcagttgctactgaggcttcagcccatgtgacagggacactggagctgggatggtctttcagagttctaccaaattgaggcaaatgggcgagacttttgtatctttgcactagccaagagcaggcaccagggagaaatgcagctgtgatccttttgtagatattattattctggagtcaatgcaaccacaccacaaatactaggaataatattggtagtgtgggtgcatcgactccagaagaggatcttgatgaagcattacagtatccactacagagaggcactggcatattctgcttaccccacaaatattgcaatgaggatgcaagtaggagtagtgaggacataaaataaatcgattattttccactgggccttaatatatcagaaccattggaatttacaggatgatatttattatagtactcaaaaaaatctcttttaaatctccttaactcagaagggaattttaaaaagtccacaattcacctggtctatgaattcccttttaaaataaaatgtggtttaatcaaatttacaagaaaaaaacaaacaaccccatcaaaaagtgggggaaggatataaacagactcttctcaaaagaagacatttatgtggccaaaagacacatgaaaaaaagctcatcatcactggtcattagagaaatgcaaatcaaaaccgcaatgagataccatctcacatcagttagaaaggcgatcattaaaaagtcaggaaacaacagatgctggagaggatgtggagaaataggaacgcttttacactgttggtgggagtgtgaattacttcaaccattgtggaagaccgtgtggcgattcctcaaggatctacaaccagaaataccatttaactcagccatcccattactgggtatatacccaaaggattataaatcattctactgtaaagacacatgcacacgtacgtttgttgcagcactgtttacaatagcaaagacttggaaccaacccaaatgtccatcaataatagactggatacagaaaatgtggcacatatacaccatagaatactatgcagccataaaaaaggatgcgttcgtgtcctttgtaaggacatggatgaagctggaaaccatcattctcagcaaactaacacaggaacagaaaaccaaacaccgcatgttctcactcataagtgggagttgaacgatgagaacacatggagatgggggaggggaacatcacacaccagttgggggattggggggcagagggagggataacgttaggagaaatacctaatgtagatgaagggttgatgggtacagcaaaccaccatggcacgtgtatacctacgtagcaaacctgtacattctgcacatgtatcccagaacttaaagtataatttaaaaaatgtggttgaaaaacaaaacccacataatacaaactttgccagcttaactgttttatgtgtacaaaccagtagtgttaactatacatacattgttattcaacagatctctagaatgttttcatctctcaaatccgaaactccaaacccactgaagagctcccattgctccctgtaccccagcactggcaatatgaccactctactttctgtctctaaagagtttaactactttagatacatcatataaaaggaagcatgcagtatttgtcattttatgactggcttatttcacttagcataatgtcttcaaggtacacccatgttgtagcataggaaaggatttccttctttttttgtggccgagtaataatattccgttgtgtcctataccacattttttaatccgtttatcaatcaatggacattttagttacttcaatttttggctattgtgaattatgccgcagttaatatgagtgtgcaaatatctctttaagatcctgtttttaattcttttggatatacagatgctcattgatttacactgggattacatcccaatcagcccatcataagttgaaaatatcatgtcaaaaattaatttaatatgcctaagctaccaaacatcattgcttagtctagcatactttaaatgttatcagaacatgtagattacagtacatctgggcaaaatcatcttgcaacacagtacatagtagagtatcaattatttatcctcatgataaatatcatgctgcaacccaatatgtcagaagagagtatcatactgcatatttactagccctagaaaagatcaaaattcaaaatttgaagtatggtttcttaatgaatgcatatcgctttcacaccattgtaaagtccaaaaattacaagttagaccttagtaagttggggactaaccgtacacccagaaatgggattgctggattatatgataattctatttttattttttgaggactggattatatgataattctatttttatgttttgaggaacttccatacggttttccatagtggctacaccttttcacattcccaccaacaatgcagaagtgtttcagtttctccacatccttgccagcacatgttattttctgtttatgatcgtggtcatcctcatggttgtgaggtaatatctcattgtggttttcgttcttcatttgcatttccccgatgattgacgatgttgagtatgttttcagatgcttgttggctgtgtatatattttctttggagaaatgtctatttaaatccttgcccattttaaaatcaggttaattgtttttggtgaattccttattaattactcacctcagagcctttcttcttaaaatacagatttctcagaacctttcatctaatttactaaatgttgatcttgaagaagtattttaatttatctgaatttagtttcccgttctataaattgatagtaatcatgttttccctatccacaccagagtggtatgatgaggaaccaatgcagaaaatgactaaaaaggcatttttatgctgtccagatcttgtgcaaatatattataattgatttgaaccaaaagaatctacattttaagactatttaatattgtcgcatttacattgcactaatggttcctcttttttctcactgatgaagttctagattgaaactctgaggaaactgtaaatcacagttacataactctgttatattaatttatataacttctctgtctctctctaaatatatatatttagactatatatacatatgcatatatatatttagagagagaacgagattacacttaaggactctgcttagtacattgcaacttgcacctcattctaattgtgaaaacaacaacaaattttgattgagaccctgttatttttcagacctttggtcttgtgaggaaggaaaagatgattctgatacttatctcaaatagcttatcatctcctctggtggatgaggcttgtgagggcctgacacatggtagaggatcttattcattatataacaactttcaaaacacatcactaattatttttctgcttaaggtgaaaacgtagctctcccaaacaaataagagatttagactgaattctgtagaaaacactgcttacctcattttgcttagttttcactgcagagtcttgtctctaacattcaggtaggaggaactctattttaaaaaattgaataaacaaacccaaatcagaataaattatttaattcaggagttttttaaggtgctcagaattttggtagaatagcagtgtattttctgtaataagaactacacaatgttctctagctggttatactcaaatggttatatggattttattctgatatcagttttgcaattgatgaccacccttcatcaatagcgtggtctttattatggtttcatctggctttttcttcccttgtcttctgcactgggctgcctacttcttggctcttattattacatactctacttttttcatatacaaaggtcttagtgcattaatagtgagtttctgctaaaagtgttactttcttcaaatatcctgtcaaatgctggctgcctgatttattgacctcatagagtgactatgtgaatcttccattctctgtggaattccattccacattttaacttaaagactccgtcttttccagctgtgttctctctgctggataagcatttttcttttaatttctgtggtaatgggaagggaattttaaatcctgttttgcgtacaagtgtttaacaggtaaaaatggatgctgtgtcagctatctattgctgtgtaacaagctaccccaaatgtagagacttaaaataagaatcattttttttttttagctcatgattcttgattctgcttggggcttggttcatcgaggcgattcttttgctagactcagctgtgctcattcatgcactcgtggtcagctggtagttgatgaccacatgtggcattcatatgtctggtataactttttggttataagttgagacggtgtgggtgacaggatcacttgcctgtaattattcatcaggctagcatagttccatagcggtggaagagttccaagcatagcccaacacccaagcattgttaagcctctgcttatgtcatgtttgctgatacctcattagccgaaacaagtgacttgaccaatccatattcaaggagtggagaaacagactatggctcttaatgggagaatctggaatatctcttgacaaaagtgtagatgcaagaggagaatctgtggacatttactctccagcagagatgttgtcatttttgtcactaagacagttcctgtgtaatattatttattattccttggcagccataagtttgtggtttacttatggatacttcagtgcctgcccaatatcatgttggaaagagaagcccttaacaatttctcttaatttctacttctgaggaatgagaaaaaaaaaattggataggcataaatgatttccagcacaaattctaagcagctatttgagaggtgggtgggtagggagagatggaaaatccttttaattgagacatgctcaaccataagcaatttttctttcctcaggagacatttggtaatgtcaggagacatttttggttgtacatctaggagggagctctggccagagatactgacaagcaattctgatcctacaatgcacaggacagccactcacgacaaaaaattatctgggacaaaaatgtcaatagtgctgagattgagaaaccctgcttttcactgagcgcatgtagatgaattcatataatgttagttatagaagggcacttagatgatgccaactaaaacaggaaaaggcaatgattatttctctattcaagttagtgaaggaaggatatgtttaaagtcaggttggagatatttctcaagggtaatatttaagttgtgagtggatgccagatgcgcttgattgttacaatccatatttttatagctatatcaaatgatcttctctcccaaattaaaatggatattagatatatttcatggataccatatattataagctatagctcttagaagtatttgagtgattaataattcttgcatattgaatgagacatgtaagaaagatacctgatgtcctatgattcttagaaatatgtgcagtggttaagcacattgtcttggaaacatcacttgttaatgtgagatcctgaacaagtttcgttaccttggtaaaagggggatgataacatctaccctgaagatggtttggtaaaggtgaaataaaagagggtttatgaagaaccttgcctagcacataagaatcactgagtaaatgatgggggtgatggcagtgttggtggcaattatcttacttgtaagtagtagcaaatatttatttggattatatttttaatagcaagaaagaatctattaaaatgtaagcaaatagcaccattaagctttaaaaatccatagctcccaaacttaacatttttttttcttaaatccagaaatacaaatggttatcatgaatccttgagttccagtactccggccttgcctatgtagagtacaagcatttatttttctaaaatgagaattattgatgttaggtgtgtcatatattttatttactctttagagtgacagaaaagaaagcagacaaaaataagtgtttatgtgttcatagtgtttgtttctaattttccaacttgtatgtgcagactgtaaatatttagagggaagacatgaaattcttccttacctacacaatagattgtctttcttagaatctagacatgatttcaaattttcttcagaagttctcttgaattcttacggaattcattaatccaaatgccatcctttcaaatattcaaaaagaaaatattctccaatgttgcttacatggaggagagttattttatctactagtgagatggaagtcgctaacaatctttcttataccccatagtattaaatagtaatgcaatttgatcacatataacattgctctcctgttgacatggaatgataaggaggaagggaatatctaacagcactttttagatattctctcatagaattgttaatgtgagcccaataacttattttgtaagttgagtgatttttcaaatataaaagtgaagcaaacaaaaaaagttacccacattcattcaacaaagctagaaatagagtatgtgcttcttgctttcttatcaaccaaaggagacctgtgaattacaggaaaaccatgtgtgaatacttcaaaggaaatatgccaaacacattgtgtgtgtgttttaaaagatttagtagctcctttaaagctctaagtaaagctgttagtctgactaatcatgtacccctgaaaccaattaaattttcagactagagaagtgttcttcaaacacttgaaaaaaataagagttccttcctaaagccaacaccttttaattaacaaaatactcagagcaaagctgtggtttgcaatagtatattacacctactgttattcatgctaccattctggtgtgccaaactcaattcatttcaactattttgagcttgattttctgtctgcttaactatggagggaaaaccacaattttagtagagtcattttaattttctaatgaatgcatgagaaaggtattatgctacatagtatgtcctcagactattcagatgccctctctctctcttgctctgtctctgtctgtctctctttacacacacacacacacacacacacacacacacaatgtgtgtatctatctgtctacctagatatacagtttaattttgtacattgtaatacatctggttctggcataaggtgattgagcaaaaaacaaacaaacaaaacccacccaaatctgttactggaggaacctttaatagcataacatcagaaagactattttcagtaaggaccctaggcaggaaaagacaattcctccaatggacttgagaagaatacccttagtctctgaggtggttagagaggctgagatctgaaccagctaataccagagccagcttcttgtaacccaagataggggcataagaaacggggtgaatgcccaggcatgaacagacttggggttaagattaaatagggtacacgggaaaggatttccgccagctggaggggaagccatttcccatgctccttagggatgacaacaggagacccagcccagaacatcattgaaaattctatgtaataatttatatatcctaactctttacccgttcgttctagattatggattcaggcactcttagcaaaacaaatcctctttcagtcttttaaaatattgacttaacaggaaatatccttggcacaacaatacgaccctgcctgacccttagaactgtgaacaggttgctcagactgtacaaaaccactaacaaatctgaccagcctacacttcactgaaaaaggtgatttgcatatatttctagtactatgacatggtggaaaagaaagaaccgcatatgtgttagataaaggtaaacgcatctgaaagtgcagtaagaatcaatgtgatatatacaataaaataagataaataggccgggcatggtggctcatgcctgtaatcccagcactttgggaggccgaggcaggcagatcacgaggtcaggagatcgagaccatcctggccaacatggtgaaaccccgtctccactaaagtacaaaaaattagttgggcatggtggcaaatgcctgtagtcccagatactcaggaggctgaggcaggggaatcgcttgaacccgcgaggcagagattgcagtgagctgagatcacgccactgcactccagcctggcaacagagcaacactctgtctcaaaaaaaaaaaaaaaaaaaaaaaatttcaggacttcaaaacttctgtcctttgaaacactttgattaaaaaatgaaaaaaatatatacatgcctgaatccagaggcaagtctttttagaaaacataaaatattttaagtaatgtttttctgaacagaaatggctctaatgtgagaggtcgatgaagattagcctcttgcttctttatgttttaaagtatattccttgagacccaaagtttctgactttagaatccaactctcaactactatcagctatcctctagacactttcaaaatcctccaaaacctaatagtggtgcaagattttgtccttcctagtgataactagatttaagtaagaaaacgttaaagactaaaaagtgtttaggacccacaagaaaggtgtaattctgttcctcatggagatattttagttacacacttcttattctggtcctccccaaaacacagaaatctagagttgacatttaaagagaaaatgagatttttgtctggaaacaggagagaaaaagttttcaagaagtatagaaagcgtatgaaaggacacaggtttgaaatggcctgtgctcatgagagaatgcacaatagacatgggtgtggaggagcctggaaagaatggagagaggtaagtctggagggtcaaatctggttcagagtacagagcataaaatcccatacgaatgtagaacatgaggagccaataaccattgtgtgagaaatgcaggaaaaagaggaagaaaaaaatccacatagtgtacttacagtcagaacaatcctaggaggtgacttacatgtatgatgtcataaaatccgtaacacaattccattagattggtactgttttcatagttacacaggtgaaaacttttgagggtcaagatgttcattgtagcaggcatagtataattccttacctcaagatgcctccaatgtcagtgaacattacttttccaagattgtctatttaggaaaaagtaaggccagttgtctatgaaggaagtactattataatcgccactttacagaggagtaaatggagattcagagaggttaagtcatctgactatagttacacagctaaaaaaaaaaaaaattatagagcaaggattcaaatacaacaatctggtcctagaaagcctaaatattctacaccctgctttctgattcagagctatttcctgcttttctcccttcgataggaaaaaaaatgtatgtgtgtggggttgggggcaaataaattgactggctgtattttctctctttaatatttgatctttcattgtctgctccaagcagtgggtcttcctccattatcttctcgtgaaaatagctaaaatcacctaactagtaaaaacctaggcatgttttgtgttctagcctccattcttccattctaatgggtggctgttaaattttagtactcattgtatgtagaagacctctaagttcactaaagagcttactgcacattgacttttctttagattcaaagggaatcaattgagcacctcctatactccaggacatgtgcaagatgcaagagatagagcagtgagaaagtctgataaggtttcccctccctttcccagcagtgtacagatagatgttcttcaggtggtgcatgctggagaagagaagaccagaaatactggcctgacgggtctatagatgagattatctgcccatgactggcgcagggatggccgcattgctagacctctccatcatcctctgaatatgcttcagctaatttatcatcccaatggcatatttagtcatcatgaaccattctctctttttgagtctcaggccctggccttgcttttcaatagacttccaatagattccttcctccttccttcccttactgcctggcttcctgacttccttccttcctgccttcctgccttgtcttgccttgcttttcaatagattccctccctccctccctccctccttcctccctccctccctccctgactttcttctttccttcttcctttctgtctttttccaaacgtgcttttcaggaaacagtggtctgcttgttgaagtctgataattctctagttcctcatccttcactttattgaaatttagtgtgacatgatcatttccacctcattaggtacttctttcatggtcagaagtaagtctggagaaaaaaaaaaaatctcttgtctctgctcttatttgagggtcaaattttcaataagtcactttttaaaaaagcattttctgacacttcccataagcttgaaatcctcctaaattgctgtatattgcctcagtataccttgtgtatctattttaggaacactccatccacatttgccagtcagcctggtgttctgcagttagttcctacagtgatattttaatttagctctcttttcatcctcacacatgcatcctctctggatatttagctcctttcctggaatcccttttaagatttctagatctttttgcttccatgatttcttctcctggactgtgacacaaaatgctatttcttctttacattacatttaattctttctagaaagagcctcagagtagtcagatagctttgagaaacaaaactttttctttattgcctcactgttactgcctttcaatcattgtttcgtgacacaaatttttttattctctctgacaattaaaacactatttttttctgtctgcattgatcaaaattagttccttcattcatagaaaactcttggtgtccctgagaagcttgagagacaagaaacattcttccattctactcatcttcttctctaatgaggagacaaccttaaaagcacagttacatagccataaaaattaatgattggctacctcagaatgaaaattcaatgtctcatttttttttaatattcttagaatcgttcactggttgtccagtgtgagtctcctgttgagatgtcttttgcagctttccttgaaacctttcattccaaactacatagtccaataattttgccaccaatcttctggttatattatgctcttgagtctgttgtctataaacttgattaggcattccttcccctcaccactcacctctgataacccagctgtgtgttggtatttagtatcaattcacaccagcaagttcagccctcttcaatcaatatagggccacacacggacttttgactgactactccccaagtatttcacattttggggccttatctccagtttctcaccacagttgttcatcactgtgtttcttactagccaggcgtttataaaaacagtaatacctaacactattgatcacctactatagtgtcaggcgctgtaataatattattgtgatgatgatgattatgctgctctttctggcattgtcatacgtgtattgcttgtactactcactgaatctacacaactgcccttatgacatttaccctgttattattcctcttttaaggtaaatacatgaaaaatgcttcccactttgccttgcttactgcttattgctagtactgaacaaatgttagaactgaaacttagagaggttatgtggctttaccaaggtcccagagttcctagggcagagaacaggattgtctaccagacattttaattctagtactatgcatcttaaccattaccataggctgacttactctacagtgtccaacactattcatattaagatttatttaatgactttgaaacagtatttcatgtctaaatagaaaaactactaactcgcatttttaagaaaatattgtatcttggtttttcttcactgctggccagtttactaacaatctgaaataaaaagaaaaaaatatgataaactgctcccagtataaaatacagagctaagacaagaacgtttcattggctttgatttccctagggtccagcttcaaattaatttacttcctattcaagggaattttaaatcagaaagaagatcttatcccatcttgttttgcctttgttttttcttgaataaaaaaaaaataagtaaaatttatttccctggcaaggtctgaaaacttttgttttctttaccacttccacaatgtatatgattgttactgagaaggcttatttaacttaagttacttgtccaggcatgagaatgagcaaaatcgttttttaaaaaattgttaaatgtatattaatgaaaaggttgaatcttttcattttctaccatgtattgctaaacaaagtatccacattgttagaaaaagatatataatgtcatgaataagagtttggctcaaattgttactcttcaattaaatttgacttattgttattgaaattggctctttagcttgtgtttctaatttttctttttcttcttttttcctttttgcaaaaacccaaaatattttagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggtatgagaaaaaatgataaaagttggcagaagtttttctttaaaatgaagattttccaccaatcactttactctcctagaccatttcccaccagttcttaggcaactgtttctctctcagcaaacacattactctcactattcagcctaagtataatcaaggatataaattaatgcaaataacaaaagtagccatacattaaaaaggaaatatacaaaaaaaaaaaaaaaaaaaagcagaaaccttacaagaatagttgtctcagttaaatttactaaacaacctggtattttaaaaatctattttataccaaataagtcactcaactgagctatttacatttaaactgtttgttttggcactacgcagcccaacatattgcagaatcaaatataatagtctgggaattgattattatccactcttctaagttgtctgtgccaatttgccttctccaatgataaggataattgaaagagagctataacttaaaaagagaaaagtaacaaaacataagatatttaaaattaccctagatcttaaagttggcatttatgcaatgccatgttcaaatgaacatgtttttaatacaaatagtgcatttttcagcctcagtgtaatccatttggtaaaattatgacatcaactagaaacattagaatacattgatgtaaatatggtttacctagctagatcaaatatactatatatcttttatatttgtgaatgattaagaaaaataatgttggaattgttatacattaaagttttttcacttgtaacagctttcaagcctttctaaagaaatacaaagttgtgctgaaggtatttaggtattaaagtactaccttttgaaaaaacaagaagtgaggcagacagagtaaggggaatttctttgtaaaataaacttcaccaattccataggaataaaagtaatttgatagtaaacaacctgcatttaaaggccttgagcttgaatacagaagacctgaattcagtgccatttgcaaatgatgattgtggtcaagccatctctggatcttcgtttcctattctgagtacagagcatacagagtacacattcacattcacaatatagttatggatatggatgtatataaatatatgtaaatactacatatatgtacctaaaatttgttttacttctgctttaaaaaaagtaattatagccacatttttcagaaaaagtaactgaggctcatagatgtcaaattcccagtaagtagcagaacaaggattcaaatccaagtccatttgattcctaagcttgtgttattacttgctactgcagagagtatacgtagcaagtaatatatgtactgcaagcaatacatactattgctgcggtaataactgtaactgcagttactatttagtgatttgtatgtagatgtagatgtagtctatgtcagacactatgctgagcattttatggttgctatgtactgatacatacagaaacaagaggtacgttcttttacaataccatattgagttatataatactcccaggacttttatttaccaaaggaaacaatattttataatgtttaaagcccaggttttgaagttacattgtctgggttcaaagcttggctcccaagctgtgtgaccttgagtaagttattctgcctacctgagcccaagtttatctagctataaaatggggatagttgtactatctgccttgcagtttgtcatcaggattaagttggttggtacatgaaaaatgcttcccactttgccttgcttactgcttactgctagtattgaacaaatgttagtaattatatttggttccaccacgaactctagaaatctaaccaatgatggcatttgtattatgcaaactgtatatcacatcataatattatatggaaatgagagcttgtttccgcttctgtagcctagtctaccattgacatagcttcctgcagaagttaccagataatagattgggagagaaagtccacacttccttgtgacgggtttgtgagtccagcatttagggaagccattgatgtgctcagtagtctccagagttctctaaataaatgtgtccttttcagaaaggactactgatttgatgccccctcacagagatcgtctttaaatataggtcaaaaactaatgtagagggccaggtgcaatgtttcacgcctgcactcccagcgctttgggaggctgaggcaggtggatcacttgaggtcaggagtttgagaccagcctggtcaacatggccaaaccccatctctactgaaaataaaaaaattagctggtgtggtggcccatgcctataatcccagctactagggaggctgaggcaggagaatcacttgaatcctggaccagaggttccattgagctgagatcacaccattgcactccagactgagtgacagagtgagactccatctcagaaaaaaaaaaatttagggggaaaaatcaaaagccatttctgagacacaaaaatacaggatttataaattatatatggtatatataaaaatatttttaaaatagtatatatagcatattatatataatgatatgtaatgttcatatattacatatttataaaaaaatctaatctcccttctcttgcttgctgaatagggggatgctttgcctgcctcttcctcttatattaaaaaataattcttaaagacattgtcagttcttggcttttatagcctcaatcaccaaattgtcggtaaaatggccctaaataatcattaaacaaatgtgtgtgagaggggaaataagaaggataagtaagtatggggaggattttgttataatttcaggaaatcaatatcaattttatgtaaagttttaaataaagcaatcccaactttaatgtttgatgtgtgaaaaattaggcaaaattccaaaagggctttataaactgaaaaaaactttactaacacctatccatttttattattttaaccaacttctattgagctgccactaagtacctgggaaacataaagttgtacaacatagaatgtgcaggtaaaagaggttgaaggaagaaaataataacactatgatagagataaattttaggataatagctaacacatatgatatgccagtcattgatctaagtacttcacgtgaattctttaatgcttacaacattactgtgaggtagatagagaggcacagtaaggataataacctgcctgagatcgaggaagaaagacaatgatgagatgtgaactcaggcagtttggttccagagtcctctcccttaaacctcatagttttcaacttctctgatattgtgtgggtgatgctgttggggctttcttcagggaaaactaagccaggagagagaatggatgctagtgagatattcctgaagaaggaaaaacttaagccaggcattaaagaatgagttggaattacctagctagataaaacgagaagggcaatccaggcagagggaacagactgtgcttttcactgaggtggaaaaaaaacagagtatatcagaggaattgtgattccatatggctgaagttaagggtatatgatgaggaagaaattgatgaggttgaatagagaggactggggctaaataatgggaatcctttgttgccagactgaggaattttgatgatggcctacaggcagtggcaactctgaaaggattgtaaacaggaaaataaaatcatcacatatagtttagttgcctatcaattagagctctctggatgcaagcaacagaaatcattctctgattaaatcaggcagaaagtaaatgtgctgtaattagcacaaaggcattggaacaaaacttacaaaaggaaaaagaatctgagcatgcctttctgggcatgtggctagcaagaagtattccagtctgtttgtgatactctcttttctccatcctgtgtgtaactctgttcaaattttaaagtcttaaaagagagtccagttcaccttgtttgggtcacatgttaatacatgagctagaagggagcagaaaactttgatttaaatccctctcctcccaaagtctcaaaattagggaaaggcaattctcctgaatagaaactgggttctattgacaatagaagaaggaaatgattctgaccaaccactaaacaataattgtccactgaactcagtcaagaacatgtagaataagttggaggatagagcaaataaaggagatttgtaggaggtaattattatgatctaaagcaagcttgttcaactcatggcctgtgagccacatgcgtcccaggatggctttgaatgtggcccaacacaaatttgtaaactttcttaaaacatgagatactttttgtgacttttttttgctcatcagctatcattagtgttagtgtattttatgtgtggcccaggacaattcttcttccagtgtggcccagggaagccaaaagattggatacagctgatctaaagcaacaggttcatctactcaacttcacaacgtgtagacctgaaataaagaccattcatataccaatacctgaaatataaatttgtttgaccatgacacgtacagtaattggttctcaataaatgtggatagcttgatggataatgtgaatgcaatgtgataaggaaacttcatattcaacaaagactggaatgtgaggattataattccaaagcaccagaagatagataagataatgcaatgagacattttatgactcaaggcaaagttagttatgagattcagaccaaaccttagacgtgcagtaattgaaatatttgccacagaaggggtataaggacatgacattcaagtaagctaacctttcactagctttagactttgaactcagaaaacatatttggtgaaaagcttatggtcccctttagtatgtattgcttgattaaagtattattttagaaaatggtgagctgcttccattttgaaataaaaataatttttactaagtgaattatattcagtgaaaaaaatggaagctacaattacaactttaatttttttaagttttaagaatacagccatttaaaaaaattaagcaaatctgcttcattttagacagtagaaaatataccattatcttttagaagaatagagatgtgaaatatgcaaattaagcctttagaagtaaagcacacatgaagttcaaagtttaatttctagaattgtgaatcaatagcagtggatgatttgtactttatagcttagtgtcggagaaatctgattaaaaaatgctttttctgtttcatcacataaacataagtaaaattgctctgaaacaacaatatttgacaagaattagcagttttcttttttgacataatctatcaaatgaagggaaaaatatgtcctgggttttgctttgagagtgattactaaatctgacccttaaggaaaggaaggagagaacaaagaagggaggaaagaaagggaaggaaggaggaggaaagggaaaaaaagaaggaagagaggaaggaaagcaggaaaaaggggaaggagagagaaaagacaaaagaaaggtagcaaggaaagaaaaaaagacaagaaaggaatattaaagaggacaaaagaggagtgaggaaaggaggaaatggaagagggatggtgggagacaggagggagaaaggtggagggggaaatatgaagagaggttcccagcagtggagactagtgttgctatcaacaaatagaatttagatggccatatgatattatttttcataatactggtgtctgattgcctgtgctgagttaattgtagtcttttttttcaattccgtttggccaggtgttcaggataattcaccacaaaatctcaaccactgcacttgtattgaataaagaattgagttggcaaaggcattttatcctccagtaagacctttccagattggggttgagacaaattggccaatctggacaagatgataatagcattgttcaagattaatttttaaccacacattgcactgttacctgggagatttcattatctaaaaattgaatgagcagttttagtgggtatagtgtatatttaaatgggacataattacttgaatgagtttaatttttgttgttgttgttaaggtcaaagtacttaaaaattatgattttttaaaactctgtctatacacaaaaagcatttgaattagctacagaataattctgattataacttttggtgaatagattcagtcaaaatctgattactaaacaacttgtgtagtatagccctggaagaattgatgggacaatgtgtgggtaaagtggcattggctatttaaactaaaagcaatacaaaacagaatgtttcttggttttattctgttgtcacaaacccagcagaaagtggctattacaatagtttcccttattcaacaaatgagagaagttatagacaatttagttaattgatctaaagtcacttagtaaatgtaattgtcctaacataaacccagacccccagacctcttgggaatagataatgtttcttacttcttttctatttcctcagccacccccctcaacttcttacacatctcatttctccatccaaattataacaaaacaaagcaaacatggtttatttccatgggcatcaaatggatttcacgaggttgggtgacagtcatcttagggtgaggagattgattattctgtttttctctttcatcgatcaacaatccagcccttctcatctcatcatttcatttctgcacaaacttgtttaagaaataccaattaagaaattaattaagaaattaatgttgtaatctgtttggctgaagatatttacaaattttgtgctttaattatcttccaacaaatgtacatgtctctggtagacagcttgcgaccatctggatgactgatccatatttatataattttctttctttacctaatgagaccaaatccactattatcttcaacgaaggatgtaaagatatgtcagtgtcagtaatgtgacttattttatattctctggtcataacaaaaataaaccgccccttaaataaaaaggtcatagagttgcaaacacacacacacacacacacacacacacaaaatcatattttctaagtctcctaattacctttttatggaaaatgataccatatgcttttttcttaaagaaactacataaacttataaactatactaaactacacatttcaaagtctatgaatggaaatgtgtatcttattatattttaattcaattcactgtaaacttttctgtcaaaatcttatcaagcaaaactgatccaggatatttacatgaattctgatggaagtcactgtactgtgttttccataaaataccagtgggattctgataaggaagtttatgtttgccattgtgtttaaatagagaattctgggccgggcatggtagctcacgcctgtaatcccagcactttgggaggctgaggcgggtgtatcacctgaggtcaggagtttgagaccagcctgaccaacatggagaaaccccgtctctactaaaaatacaaaattagccgggcgtggtggcgcatgcctgtagccccagctactcctgaggctgaggcaggagaatcgcttgaacccgggaggcagatgttgcagtgagccgagatcacaccattgcactccagcctgggcaacaagagcgaaactccgtctcaaataaataaataattagagaattctatttacaaatttcctttcttggatctagttagggctcctttatatggagtgatttttattgttttcatagaaatacgtagaatctgggtcttctctaactttcttacaggaaagcaatgtaataaggtttttttttaattttctgaaagttatataatgttattgttccctaaagtttaggacctgccttttaggctttccatttcaccataacttttggtccttaaagtctgtaattgaagttacagtgtgttatgatgtaaatttttcttattattacctttaatgttagggtaatgttaactaatgttaatgttaggtatatggttgtttttttcattccttcgttcaacaaattgtctttgaaacccatgttacaaagcactctagagtcaggttgaagactattaagaaaggagaatagaaagagacactagagtaataatttggatttaaatttgatttccttgtgtatgatagtgaataagtgtgaataagatgaggcagtgatcacacatcactattagtaaaagtgtttctgtacctgtatccacacttttatgtatatggttacttatgttaaagtgatacatattatataaaattaacgtatacattaagtagatattttaatagtctgtaattaaatactactagtattttctttcctccttcaagtgcttacttttgatacctcgagttacagtgtcataaagattctttagaaatatattgactgtcttttaagagcttttgatacaatactgagtttacattcatctgttatttattgaacacttgctggtgaaaggcatcagtgttatctgctcttagggaacaaaaattaaaaagggataggccctaattttagagtgtatcctctataagaaaaacataaaagatagggcagtcatggccacaaaagaaaaaagtgttatggtggtttcaatcatatatgtattagaatgaataaatcaactgatcaattgtgatttcttattctaaatatgtgcctgcctttttcatatagatgaaaattaagctatgtttatctttccagggatcttgttgatttttattcaataacttgggagtgaaagttgatttttgcatatgttttaatgtttttaaatttcataaatgaattgatcagtaatttccaaggtagtaatggctgcattgtttttgaaaaaaaaaaagcaacaggatttgattgtgcttttatgatttttaaagaattcattaaaaataatgccacggtttctaaaatgatttgagtcaatttcttattcgatttataaaaataactttgaatacaattttagtaattcacaaatgctttcagttcccttacctttatattttatattctgtgtaaacaagtgacataatatttaagaattatatatctcctatgatttattcaagaaaagaatatatactgtattatttatttcaagaacagaaatgctttgatttaactgtcatcttctctcttcaattatggaagcaaaataaactgtaatgaccaatgtaacccctcccccatatcaagttaatctatgttcaactccagaattatttttgaacactcaaactagaaattaaaaaaaattaaatccatgaagacgatttttgccaaaagcatatagataaattgagttgattctatacttaagaaagtggagaggagagagtaatttggagagagtaatttactcttaatcccatattttttccctaaatgtgaaagaagtagattgtagtgagagggaaaataacctgtagcaacttcattgaggctaagctttctgtcatgttatattatacgaaagtaatgaaatgcttccacagatagaatcagaagtcccctctgagaaattctacataaaaattagcctgccactttaccacacttactcaagtttgatttttttaagttatgtaatagatgttaggcactagaagaggacatttactgggggcaaagatcagtagttggaaagaatgcaagcaggcaagaagctatatataatgagattttacagtacaattgttttctaaatgaaaatgaggacgggtccagacacaatggctcacacttgtaatatcagtgccaggatggaggatcccttgaggccagaagttcaagagcaacctgggcaacagagtgagacttcatctctacaaaaaaatgaaataaaaagttagctggctgtgatggtgtgggcttgtagccttagctactcaggaggctgaggtgacatgatctcttgggcccaggagttcgaggctgcagtgagctatgatagcgccactggattccaacctgggcaatggaacaaaactccatttctaaaaaagaataaaatataaaactaaaataataaataaataaaaatgaggatatattttattttaacatttggaaactttgtaggtgaggaccatgcaaacattcaaggtgtgagttctgaccaaatccaattattaaccataccaatgacttaaggtttcttcacactccttaaagttgattaatataatgattatatagttgactggtatgtcacagcttgaagcctttgagatttattcctgccttttctgtaaaggttgttttgttaattccagtatgtactggtcgtttttgttttgttttgtttttgtttttgttttgtttttttgagatggagtctcgcactgttgcccgggctggagtgcagtggcacgatctcggctcactgcaacctccgccacctaggttcaagcgattctcctgcttcagcctcctgagtagctgggattacaggcactcaccaccacacccggctaattttttttatttttagtagagatggggtttcactatggtggccaggctggtctcaaatacctgacctcatgatccacctgccttggcctcccaaagtgcggggattacaggcgtgagccaccgtgcccggctgccaatatgtattggtctttttcatcaatgattcagtccaaaatcattttgtcctttaactatatattttcttgtaaagctgcttctgttgtcttgaacttttcttttcaaatgtatgttgtcatttgactttttagattgttattttctggtcctcgaaataaatttaaatttcctgtaaaggaaggtgtaatattctatttgacatagccgctaaagatgtactaggtgctttataaatattgttgatttactttatcttcacagattactagttttacttagtatttggaatatgacaacattttatagagctatattcatatatatgtttatcttaactgttaaatgcaatatgattcatgtcttgttttggtcaatgatgaatgaaagtctcctgagaattaaatttactgcatcgatgcaaaaacaatcataattttagacactctaagaattttagaaattaaaggattttttttttccagtttactctgttaagattgtgtttagctatgcgtgacagcattctcactacagtggcttatccagatagtttctttttctcatagagcaagacttccagaattatgtgttccagggtcagtgcagcacctccaaaaccgtatgtcccaactttttcctccaaccccagtcatctccaacatgagactttctttttgttttgttttgttgtttttgtttttgtttttgttttgagatggagtctctgtcgccaggctggagtgcagtggcgcgatctcgactcactgcaacctctgactccctggttcaagggattctcctgcctcagcctcctgagtagctgggattacgggaacgcaccaccacgcccagctaatttttgtatttttagtagagacggggtttcaccatgttggccaggatggtctcgatctcctgacctcatgatctgcctgcctcagcctcccaaagtggtgggattacaggcgtgagccaccgtgcccagcaagactttttttcctgtggtctcaacatggctactctgcctccaggcactatgtctgtactttaaaatggaagaagggaaaatggggaaagtaaaagcatattccagctgtgtcagctcctgtttgtaaggaaaaccagtgcttttctggcagccccacacagaagagtttctacttgaacagtgcattaaccagaaatgtgtcacgtgaccattcctaacttctaaggatcttgggaggattgagtgttttaactgaataggtgtgtttctttcttcataattcaaaatgtgaaaattggtaacttagttataaaaccttgctagtctgaacagaatttggatttttttagctaagaaggaaagaaagggtatcggataggcagctggctatgctagccaagatactcttaataatgcacatttttcttctttggacataagcagttttaacttagctaaatatgatgtgattgttttcctgtcttcttagttctgtttaaatttgtttcagaaatcaaggaaataaaatggagaaaaaactctattattcatgtctatctttctgcctctgaatatttttatgttggagaaagagaaagcagtaactttcataatagcttacatagtctgacaaattctaaacatgtccgttagcatcaatatacgtggtattaggtcatcagtttttatattctgaattattaagacccaaataaacccactgagttcaagagaaagtatacactgagcaataaaaacattaccagttctagcaatgataatcaaacaagaaaacaagtaatatagtctgtttagaataacatgttttaaagatcaagtttttcttccttaccaatgttgcctttcttgtaacacttttttttccttcttgagataggctttcctatcttttgtcacaaaccccaatatttacatggccattcgtagtctattcatagcagcaccaccccatggcccaaacttgtagatattgccctccttctatggttgttctaataagaataaccactcttgtctctcataatctcagctgttttgtgccgttaaaatggaaaataatgagtattaagatactaactaggggccaggcgcggtggctcacgcctgtaatcccagcactttgggaggatgaggcgggcggatcacgaggtcagaagattgagaccatcctggctaacacggtgaaaccacgtctctactaaaaatacaaaaaattagccaggcgtggtggtgggtgcctgtggtcccagctactcgggaggctactgcactccagcctgggcgacagagcaagactccatctcaaaaaaaaaaaaaaaaaaaatactaactaggtttcagtcatatgagatgaataagtcctacaaatctgtacagcctagggcttgtagttaacaatgttttatatttaaaactttgctaagagagtaaatctttttttacctgttattatcgtacatgcaaaaataatagtaaataaggaaggtaagagaaaaattttggaggtgatgcataggtttatggcatagattctggacatgatttcacaggggtatacagtcatgcattgctcaacaacagatatacattcggagaaatgcatggttagctgattgatcttgttgtgcaaacatcatacagtgtacttacacaaacctagatggtacatcctactatacatctaggttgtatggtatagcctattgctcctaggctataaaccagtacagcatgtgactgtactgaatacttcaggcaattggaacacgatggcaagtatttgtgtatctaatcacatctaaacatagaaaagttacagaaaaatattataatcttataggaccactgtcctacatgtatacagactgtgcacatgatagtggtccattgatcaaaatgtccttatgcagcacataactgtaattatctcgaaactcatcaagctgtgttcattaaatgtgtatagctttttatgtcaataaagtggttaagaaatcaataaagtggttaaaaaatattttgactaggaaatatactatcatttctagttgataaaagatctcaacatttccaaaattgtcctacagaaaaccaggttcatcaggtgttcatacatgatcctcatgaaaaggtcaaataagctgaaaaacatgcatagacgttgcctatcctagcaatctatgatgtacatctccatagtaaggtcactgaaaagtcttttaggaatgttagtattgttagctcagtatttctcagtgatttctccatggaaaccatttgtgtagagcatcttgaggagcacagctgagagaacattatcttagttggatgtgtatgtccctctgagtcacttgatttctctacatatgcttttaccaaattaatcttttagaaatcttttctcttcgcactatgtctataatttgtgaagttgttaccaggataacatttgtgcctctcaccatgatgtacctaccagggtccaagcagccattccttctctagagcaactgtctgagggaaagaatttaacacagcattctacgaaatcattttatttataaaaatagattactgctttacatatagtaatttatatttagaatattgattaattattaaaatctgcatgagagctttaaagagtagtacataatatatagcagtttgtactcaaactgtcttctaaaaaggattcactttttgtttgtattctattgtcctattcgttgatagtgttacgtaagtaattataaaacttaaaatctggaaagagaatgtggactcagaatgccatctcttttgttatttcaaatggattagaaatgaacatacatattcattttctttcattacacatccagagaaatagaatggattttataaatatgtaaaagcaaggattttgatcactgataaaaagggaaggtttggtcactaccttatttcattccttttttcttatccttttttttttttttgtcaattatttgatgacatctctgaacatcaccttttattcatgacaagaattgggtatcatggtaaagaacactgttaatataattcagttacttcaccccctcctgaaatatagagaagctttaagactatgtgaatatttttttctggttttcttgtatttgtagaaatagcatgagctttgtttaaagtcaggcatctaaaaccttgccctgtatgttattgacaacctgcacaaattttaggatctattctattacagtttgttcaactgtaaaactaggatagcaaactctatgtcatattttcgttatcagaatttaaaaagcatgttttaagatcttagtaaataataaatctctactctgtagttgaatttgttctatattctttaagaaattccctttgatggttatgccaacctctgtattacttttcttcacactttaactttgcgctgaaatcatagtagtattttacgttatcagtcaaaataacagtcatccttaaaacaaatatgaattttagatgattaaatagatttgtatggaggttcttcttgctaatcatagcagttatccttggtgaaaaatgatagacacttgaaaaaaccaattaatcatgatggctatttttgcatcataaataaagctttcaaatttgagagggaatcaaaagggcaatggtagtatagtgtctcaaagcccctttccaattgatggtacaaatttaaaaagagagagagagagagaaacatgtttcactgtaattgttttctaagagcttccaaaaaagcgtattttcttaatagattcaaatttttcagttggattgaaagggaagtcttggagtgtagtgaggagggcaccttctgttgagaggtgttcagacgacagagtgtgcccaaggccaaagatgagatggttttgcgaaagtcagtggccacaaacaggtgtgtttgacccctgagagatatgcaggaagtctaccccactttaattcttccaaatattctttaccttaattcccaagtacttgataaaggagcaatggggagaaaatatgcacactattatggaaaagttttgacctacactttggagagttttagattaagagcattctagaaatcagtcccaaatgcctagggtttacttacttaaagataatatcatagtttgggtgactgggaagcataccctgagattgaggtgagcatgcagtatgtctatttaggagtgttcttggggtcaacgtgtaggggcagagggagaagttgagctctgacgcagtcttagtaagggcctcagctgaccgttcagggagttcttaagctggaatgacccttcagaagtgctaggaaacgaagaaaggggactggatctttataaccccgtgtcaagtcatgcactggatgtgggctactccaggaaggcaacgaactttagcaagatgattctctttagccacgggaatttccataagggggctgctatggtctgaatgtttttgtccctccaaaatgtgtatgttgaaacctaacactcaaggtgatggtattagaaggtgggggtttgggggggtgattaggtcatgcgggctctgccttcagaaacaggatcagtgcccttataaaagcggctccagaaagcttccttgccctcccaccatgtaaggacacaccgaagatgccatttaacaggagtgggccctcaccagacaatgaatctgctgatgtcttgatcttggaattcccagcctccagaactataagcaataaattctgttgtttataaattacccagtctaaggtatttagctatagcggcccagactaagacaagggctgacagctgaaggctgtctaccagcagcactcctagcagctggggaactaagtccttcatttccaaaggggaatctaggcagcatatttacagcttttcactacagataagctcattatttcaaatagggactagcaggaaaaaattaaattgcccaaaatttagtgggatgctgaaatagattgtggtgtgtaaattggagtatagtgaggagagcaccttcaaaccagtatgtactacatgatattgtttttgttgcaatatttattatatacccaaacacacatatattacttttagaaacacacaccacatatatatctatgaatattttatatacacatagggaaggattgttgatgttatttatgctattttaaagatcgatgttttcatataattatgtattggttatatattatttcttgatataaggtaaaaaaaaaaagcaaaacaaactttaagtgatcactatgaaaagaatcccaatgctgcacatttaggtttatccaactcttcccattaaaatattaaatagtagaaataattgtgaataagaaagagcagattttgaaaaatggaaagaaatgcttaaagacatagcattgttgcccaaccatcattatttaaacatacagtgtttggctttgaccaaattgccttcaaacacttccttttggcccaaaatgttaggtcatatatactaccataaaattcatgatgcttaccatgcattaatttctagtatataccaggcattgtgctatgcatatcatattcaatatttctaatcctctcaaaagtggtacaagctaactggcgtttttcttgttttgaaagggagaaactcagagaggttaagtgacttgcccaaggcaatgccattgataagtgccagattctatcacaggtttattggcaacaaaccatatgtgcgcgtgcatgcgcgtgtgtgtgtgtgtgtgtgtgtgtgtacacatacacgaataacatatatggtataaatacgtggaaacataataaactgcattgagctgcgtttataattagtatttaggacatgtttggcaaataaaaacagtggagattgaaatggatttgcttaggaaaaatgatacattaaaataggctttattatgagtcttcaactattctgtgaaaatagatacccagggaagaaataatagagaatatgaatcttgagcaggcaactgagaacttgtcgaagagccaagataaaaatgtcagagaggagaatattttggcagctcagatgagcccccagagggtgggaggcaatgatctcaccgcagtctcgtatctgaaccccaggtttttgcatctccataaagtaatttcttacacccctcaataatgatcgggcttactctcaatctctcgctctctctctgtgtctctctcacgcacacaaacatgcagaacatttcttgcacatgcataactcataagacgattatgtaaataccagcctttttatttcataactaaattacaaggcctggttattgtttggactgtgaaaaaataattatgtgaataggtgcctcaagatgaaagacaaggcaagattgtgaaattattcatatgatagtaatagtatgcaaaaaataacacaatctttaaagatctttaacgacctagttataaaaccatgctttataacaaatataaccatgaggaaataaaaagaaaaatgtaataatatactccaagaataaagtcaaatgtattgttgaatgtaaggagttggttacacttccttatagtggaggttattttaaaatttgtggcttacgtggtgttatgaattgccctagatcaacactattatgcaaggccaactattaggttatttttggtagataaccacagcaaaactttagtataataggtaaaggttagctacactcccataccctcactctcaggtgttgtcatactccgtataaaaggttcaatcaagggagacatgagaatattccagaatctagaggcaggatgcagttaaccttagagaaggcatcagacaactagaatcttcggattcaatgtggaaacaaagcatagtttaggcattaaatcttgggcaccattccaaagaatacaggttccataacttactatatttttatacctagcaagctagagatgaggaattgctctcaaatattttaaccaaagcatgtatcttaagtaacactaatctcataagtgaaaactcatttctaatattcattttgctcattagcaaggcctctagtgttgactgtgataaaaaatagttcaaatgctggtagaacccaccccaggagactggcctttctgattaaattctaactctatccccacgtgaattcctgacttaagtaactgagttcctgcacatcagaatataagtatattatagatataaaaacatatgtaattaataaatattttaagtgagacacttctttcatctttatggcttaactatatcagacatttgattatttttagcggtctaactacaaaacaaaacacaaagcccacaactaaaaatttctttgtatatattgcaaagaggcaaccatttggtgtcaattcaatcatgagtgaaatgctattatacgagtacatctccctggcttgtatgggggtaatagggcatggaatttacagattcacaataactgagatattcacaataacaaagatatcaatatgtagcttttcccataactttgtgtaatgaaatcctcagtttgtgctgtgtaaaaagcttattgtttacttctcatgaaaatcatcttagtttttatctttatttaatagtctgtaatttgggggtaatacattcgttttgttgatactatgtgaagtggcaagcagaaaattctaacaggaatagataagcaagtatcctataaatcagagtcagtgtctctctctctctcttttaatgagtcagtctgtctctctctctttttccctgcctggctatctatctgtatttttcagttttgctttgcaaataagagaattgtgtgttgtaaaccaaccaacttaccattaattttctctgaattcaaaagcaattacaagcggactcttgagtttgtgctgcctggttgtctgcatataggccagatgtctagaataggatctttatttactatttttaccctcctaatttcatggtaactccaaggtagatgatatttgtaatcgtacactacttgtcagaaatctttctaataacactgctattttataaaaataaacattaattcagtataaaattttattttaaattgttaattcaagcaaatcagtgaggtaacttttacactgccgagcgtacgtgtgtgtggattagtacagccatgccatagacttcacttgtaatcttttctttatattttttatacacctgaaatgttcatcattgtgctgtagaaaacaatctcattgtgtttttaaaagctagagtgggtattgagaaggggaagaggatcatagaaaaagttggttaacatgctacttaacacttcaaatctttactcgatgtcatcatcagcaacattttaaatttatgcttctactagtttgcagttcttttcctttgattattcttatgatacaagcctttccacacaaaatttatgtacaggaattgtgtagaatttttctttggaaaatatggtgatttattacaatttgggcaacatcatcattttaaaaattcagaatttgatttttctcagaatcatcagaaagaataaagcatatatatggttcatgtcaggagaattagaacatgagaattaatatatctctgatcttttaaaatattttcatgtttgtgaatcagcagatttttcctagtttgagatttaaaaaatctagatataattaaaatctcactgatgtttcaccatcagatgattttatatttgtattttcttccacttcataacttgtatagagaagaatagaagaaagaaaaagggaggattgataatctttctctctcagttcttatagcacttcattttttaaacttattacttccttctgcctgctttgtttgtctacatgtttgtatttcatgatttcttagaaatccatctactgccattctgaaggtcatttacctgaaaatgatagaaagcagcatatattcaaacaactgcagagtaattgtctatatcagttatcattgttcattacttttctgttttaggattgaggggctgcctcgccacctccctcacacccccagcatattatcacaaagcctactgattcattcacatccctgggctgaatttgccacccactgtgtgttcctgttgttttgtgtatggaagtgaaaagatttaatttgatgttgttgaaaagacacagaggctaactttcaattttcatatgtagttcttccctctccctctgcaccacctcctttacttgttgagaaaattgccctctccatggtaacaatagaagaagctttcagattttagtagtagttgttgcagagaaaagaattcaaaaagtagatgaagtttaaaaatgaaaaagagagaggaagacagctgggaagaaggcttaatgtttatgagtgggtgtggaggggaagaactaagttgaatgaacaaagctgagctaaggggaagatggtttttctgcatcccagaaggcaataccctagcctttcctgcagccttcactccccaaaagataagagctttatctgaaattcttataggattcattcctgaagagcagcttgtcaccaaacagaaacactgtgatttcctcagggagtcacagtttattattatttttttaatgtaacgcttttgtgaactccagtttccacctcaattcaaatggtcttttggttacagggtgaaagagacccaacaatacacctttcccacttccggaggcctttggttaaaccatgtctgccacaaggacacaggagcctggtatgactggttgttttttgtttgcttttttgcctcctgtgctttctagattgtgagatactgtaactcttgtcgatgacacatagtaccgaacccacccgaagaagtatgtcagtatgtcacattgtgacaaacagcttctcatgctaagtaaatgcagaaccattgtgaaaggtttaataatgcccactcctcccccgccaaagatgtccatatcctaatcccaggaacctgtgaatatgttaccttacatggcaaaaggctttgtattaacagatgtggttaagttaaaaatcttgacacggagagatagcctgggttaccccagtgcgcccaatgtaatcacaagagtcctcctaagagagaaggaggtgatgatacaagcagagtaaaagagagattggaagatgctacactactggcattgaagatgaaggacagggccaagagccaagaaatgcaggcaggctctaaaagctggaaaaggcatggaaaagaatcctcccctacatcccttagagggaatgcaagctctgccaacacattgtttctagcttgtgagacccattttttggactttggacctccaaaattgtaagataataaatttgggttgttttaagccattaagtctgtaatcatttgttacaacagccacaggcagctaatacagccatgaacatttagtaatgactaactttgcacaattttaatacaagcttcttattaaggtttattttttcttaattacaaggaataaaagtggggtctgggggcaatgtcatggtccactccgttttagccatatgaatttgtatttccagcattagaacaaaaggtgacaaatctgaatgtatttgtgtgaaataataataaagcagaacaaaaagggaaaagtgtccagctggaaatgaagttagagaaagatgaggagaagcaagccaattgtgtagttttcccttctgctttttaaaatcatgatttgtttaacccactgaattctattttagaaacaggactgcaaggaagtgttgatggatttggtggcatgagaaccagagtcacagaggcaggaaagtaaggaataagtgttagaataggaagcagagttgcttgggaagagaccttatgacatgtggacagggctagacttaggagtcagaaagacctgagttcaaatgctatcctttagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccatttacacgatattgattcttcctacccatgagcacggaatgttcttccatttgtttgtgtcctcttttatttccttgagcagtggtttgtagttctccttgaagaggtccttcacatcgcttgtaagttggattcctaggtattttattctctttgaagcaattgtgaatgggagttcactcatgatttggctctctgtttgtctgtcgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttctcctaattgaataccctttatttccttctcctgcctgattgccctggccagaacttccaacactatgttgaataggagtggtgagagagggcatccctgtcttgtgccagttttcaaagggaatgcttctatagtacaaggctacagtaaccaaaacagcatggtactggtaccaaaacagacatatagatcaatggaacagaacagagccctcagaagtaacgccgcatatctaccactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaagggcaacaaaagccaaaattgacaaatgggatctaactaaactaaagagcttctgcacagcaaaagaaactaccatcagagtgaacaggcaacctacaacatgggagaaaattttcgcaacctgcttatctgacaaagagctaatatccagaatctacaatgaactccaacaaatttacaagaaaaaaacaaacaaccccatccaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgaggcactatttacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcattcataggtgggaattgaacaatgagaacacatggacacaggaaggggaacatcacactctggggactgttgtggggtggggggaggggggagggatggcattgggagatatacctaatgctagatgacgggttagtgggtgcagcgtgccagcatggcacatgtatacatatgtaactaacctgcacattgtgcacatgtaccctaaaacttaaagtataataataataataataataaaatctcaaaataattaaaaaaagaaacaaacaaatgctatcctgatcctaactggctggctgtctttggggaagttggtaatcttttctgtgcttatttcctcatgtgtaaaaaaatgaatatagtacccagctaggtagagttgttgttgggattaaatgatgactataaagcatctagcccagcttcggctacattatagctgcttacgaaattgtagttacgatgtaaaagagaaaaacactggaaaaggaggatatgggccattttattccaccttcaccaccttttagcttggtgaccttgggcaaattatgcttcattccgtgcttcattttccttgtctataaaagggtgtaagtacagaaccattgaggggtggtcattattaacctacctcaaatggtgtctgtaagttaatatatattgtgcttttcctatgtacaatatctagcacataattacaaatcaaatccatcccatgtgcaatatctagcacataggaaaagcacaataactagttattactcttgttgtagtaattgctacgctgtaggagtttgaattgtaaggcagtggagagtcactgacctttacgagaaagtgtagcagaacatttgagtagatagtaatggggaatattacataaatggatagatattaggggcagatattactattaaaatattacagcatggatatttattaaggccaaactggttaattagttgcatctctcaggttcctaatgttgcttaattttttaacctcccattttgtgctgccctttgtacgaatatttaatgctcccaacacctcttcagtagcacatgtactgtgagtttgttttgttattacttgtgtgtattagcattcctttgtgaaccaaaagcatggaattagctgttgcctctaggctacctagttttgtagtttggattgaagccttcacctcagtaacacctattctgtctactatcttacagaaaacttgtaaaattaagacagatcattaatatagcagaaagagacaaagggcagagaacattgagatactggatattggaaccacccaatagtgttgatttatttatgattatcagtttttgtctctgcctagcctcatgccactaaagtctctgaggcaacaaagaataagcaattttgctcaccttatacaaataaaacacagaaaaaggaatcactagagaaatggtactgcagcctttctgcagggattactgcttatttttaaattacttaaaaggtattgaaattattgttcataatgagaaacctgcctaataaaacagaaaattaaacttaacacttccctataatgtaaacagctcggttaggaacacaacattacagaaaccacttaagaattgattgtacttgttcttggagcagaactagaagctcaccgtttagaagctgtgcacatttccctatcaaacagtacataaagtttccatattcctcagaatcggcttcatttgtgccatgtgtttgcttggaactatgccacagaaagcagttctccccctcaagctgggctcctttcatgccgcagtgcaagtgtgtgatatactggcaccatgtgctaatgtagacccatttttatatgataagaattagtacggcctagggaatagacaagtatgtctaaaatcctccccatagaatatgtcccttcctttaaaagctgtcatactgtaagttccagctgagttaaaggccactgtgctcctatagggaaatatattctattgtaatttttacgttctccaataacagtctgttctttgtttactgaagagagctttcatgtcataaaatggtgttttttgacagagaagcagaatcattgttttattatagaaatttgctcttacaacagcaaaaataaatagctcatctcttaagctcctgatcaatgtctaacacctcctacccccagcaacacttcactgcaagtatattaacactctataatagcaattccactcacctaccaagaaatgatcttcacaaatgatttacagctaaaccagagcttaaacacatagcacccaatcaagggcagatttttatctttttcccagtcatataagttctgagaagaaatagattaatgttgatctcccagacaactgctgagaaaatgtacaaaggatgttgtttattttgaagaatgagacctagttgttaagcactttttccccttatatgtacgtccaaaggtaaccattacaccattttgatgcaaatttaggatatatatttattcatacctctcttctccattcggatgttgtctgtgtgagtgctcacagacacatgcacacatacacacatgcactcctgtttcacacttatttgtaaaactcacaaggatttccaagccattaatatagcattgtttaaggtgaacacatggttgttcaccatccatatgtatcttcactttgtagcactcagaatttggcaaaatcagaaggctgaaacctcatggattaaatatattctatataacatatgtcttaattgctgttactgtaaagaaacctggactagccatatttgactaatttctacctaaggtatttgaattcttataaatagattcattgctttaatcacacaagagtggtttatatgaatgtaattatctccactttatagctgaataaactgagcctgattctatccctatatgggaaacatgaattgaacagctgtgccaattattttgataattcaaatttcacatctaccatgtgaagacagcagaagagggttagggggcttgaattattctgattaactgtgttcatgagtgtaatcgcctctagataatcactcatttcttcacttcacttcccatctacaggtagtatcagcgaatggtaacatctcttgctttgcctcagtttattgatggctgccgttagaaataaaaagcatggttttgtttcagtacttaaatgaataatatcttcaaaatgtttttaaaacgtgaaaaggttgaatgcatttttaacaaatgttttgttagctttgacttttatttttgaacagatgagcacaataccccagtactcctttcctagaaataggagtactacctgaagacttatttcccaaagaaaaatatcaggtctagtgcagcaatacgtattaagggcattgaaaagttatattcacaaaatgtgacatcataacatatgttaatacttcttatcactgataataatccttgaagttgtatttccagagagatctcaatttcttctcacactctgaaagtctctgtttatcctttagagtaggaatgtaagaatttaacaaaacattctgaatgtttaccttttttctaaactgaaactacaatccctttttacccctatatagtaaaatataatattacaagtagaatcagcaaatttgtttaataattctttgggacagtttttacaagcaatggggttgaatttatgttccttgtgtgcagtggagttattatattcttcttaaaaagatgcatgaaggtaaattagaaatgttttacatgttttcatgacaggacatttaatcaaagaggagatacaagaggcttttcttgggttactgcaatttaattttccatttctttcttggaagggacattggatgcagttgtacgaggttaatatttctaacatgccacttttattgtggcattcttctgctctcaaacctctgatgatttcccatggccttcaacatgatgtccttatttgggcatctagtgttctgagccctcacattctggccccagcttcccttctcaacttgatcacagccatcgtaattctgctaactaattacacagctgcccttcccactctttctcaaccactctgctgtattctgacttctacactttagttttaaagctactccttgtcctgaaattccttctcccattaggtcattattaattgagttcatcctctaagttacagttcatgttgctgttcctctatggcaccttccctgaacctggtcccatataaaatcccatctctcagaatcccattagggtaggatatgtggtctgtagactattacgtttgtcatttacatattgtcttctattattgggtaactgcgtgtgcgagcatgcatgggctggcctgaaggtcacctccccaactgcattgaaagttcatcacaagttcaattatttcactagagagtctctttcatgtcatccatgaggcacattccctactgtgatgtgttatgcatacaattatttcaataaatattttctagctctttgattgaccaaagcttaattacctgtcaactctagcctcttgtatctggaatttctacagtctttggatagtatctttaggatgcaaaattaggaggagtatgtaccaggcaaactattacaaataatgccctcaaatagttacatttcactattcatgtcttgtaatttatcttctgctttggtattttagtacacttatgattcaatttgctgtatagattcctctgaatagggacaagagaattcgtcttgataagtggaagttcgaaggattccaaaatgatgttattcaaggtagaacaagaaattaatactgaaaaaattgaggagtaataatccccaaatatgtacatgcgtatctcgttttattgggtttcactttattgcactttgcagatatttcactttttgtaaattgaaagtttgtggcaaggctgcattgagcaagtccgtcgggcacaatttttccaacagcatgtgctcgctttacgtctctgtgtcacgttttggtaatttgctcaatatttcaaacattattattattattatatttgttatgatctgtgatcagtgacctttgatgttactattgtaattgttttgagatgtcatgaactgcactcatatgagatggcaaactttgtggggtgcagtggctcacacctgtaatcctaacactttgggaggccaaggcaggaggatcgtgttagcccagaagtttgagaccagtctgggaaacaaagtgagaccctgtctttaaaatatatatgtagaaaaattaactgggcatggtggcacatggctgtaaggagccctgccagctgcatgggaggctgacacaggaggatcacttgagcccaggaggtcaaggcggcagtaagccatgttcactccagtgccctccagccagaatgacagagcaagaccctgtgtggaaaaaaaaaaaaagacaaacattttttcaactttgattttagattcagggagtacatgtgtaggtttattaccttgatatattacatgatgccgaggtttggagtacaaatgatactgtcacccaggtactgagcatagtaaccgatagttagtttttcaacccttgtttccctccctccccactctagtagtcctccgtttctattgttgccatcattatgtccatgacaacgcactgtttagctccacatgagaacacgtggtatttggtattgtgtttctgcattaattcacttagaataatggcctccagctgcatccatgttgctgcaaaggacatgattttgttcttttttatggctgcatagtattccatggtgtatatgcaccgtattttctttctccagtctgccactgatgggcacctaggctgacttcatacctttgctattgtgaatagtgctgaaatgaggatgagaatacatgtggttttttagtaaagcaatttgttttatttgggctatatgcccagtaatgggatcactaggttgaacgatagttgtgttttaagtcctttgagaaatcttcaaactgtttcactgtggctgaactaatttgcattcccagcaacagtgtatcagagttccctcttctctacagcgtcagcagcatctgtcatttttttgactttttaataatagccagtatgaatggtgtgagacggtatctcgttgtggttttgatttgcatttctctgatgttgagtgatgtggagcattttttcatgtttgttggccacttgtatgtcttcttttgagtagtgtctgtttatgtcttttgcccattttttttgatggggttatttgtttttgacttgttgaattgtttaagttccctatagattctgaatattagacctttgtcagatgcatagtttgcaaatatattctcttattctgtagactgtctgtttactctgttgataaattctttcactgtgaagagctctttagtttaattaagttccacttgtcaatttttggttttgttataattgcttttgaggacttagttataaattctttcccaagtctgatgtccagagtggtgtttcctaggctttcttataggattcttataatttgagatctaatgtttaaacctttattccatcttgagttaatttttgtatatggtgtaaggagggggtccagttgcattcttctgcatatggctaaccagccatcccagcatcatgtcttaaatacagagtccttttcccattacttattttcataagatggcaaacttaatcaatcaatgttttgtgtgttctggctactccactgatcagccattccctcatctctcttcctctccttgggcctccctattccctgagacacaacaatattgaaattatgccagtcagtaaccctacaatgtcctctaagtgttcatgggaaaaaaaagagtcacatgtttgtcactttaaatcaaaagtcagaaatgattaagattggtgaggaaggcatgtcaaaagccaagacaggctgaaagccagacctcttgtgccagttggccaagttgtgaatgcaaaggaaacgttcttgaagaaaattaaaagtgctactctgttgaacacaggaataagaaagtggaacggccttatttttaatatggagaatgtcttagtggtctggatagaggatcaaaacagccacaccattatcttaagcaaaaggctaatctaaagcaaaggactaattctctgcaattctgtgaatgccgagagaggtgaggaagctgcagcagaaaagttggaagctagcagaagtatgttcatgagccttaatgaataagccctctctataacataaaagtgcaaggcagagcaacaagtgctgatggagaagctgcagcaaactatccagaagatcaaactaacatctaagttaataaaggtggcaatactaaacaacacattttcaatatagacgaaacagccttctattggaaaaggatgccatctaggactttcatagctagagagaagtcaatgcctggcttcaaaagttcaaaggacaggctgactgtcttgtgaggggctaatgcaactggtgactttcagttgaagccagtgctcgtttaccattccaaaaatcctagggcccttcaggttatgctagatctagtctgcctatgctctgtaaatcaaacaacaaagactagatgactgcacatctctttacagcatggtttgatgaacattttgagccctctgttgagacctacttctcaaaaaaatgtgtctttcaaaatattactgctctttgacaatgtccctggtcacccaagagccctgaggaatatgtccaaagagaatgattttattttcatacctgctaacacaacatccattctgcagtccttggatcaagaagtcacttcaactttcaagtcttattacttaaatcatacatttcataaaggtatagctgctatattgtggtgagtccactgatggatctggataaagtaaactgaaaacggaaagtcctcaccattccagatgccatgaagaaaattcatgattgaggggaggaggtcaaaatatcaacattatcaggagtttggaagtagttaattccaacactcatcaatgactttgagggtccaagacttcagtagaagaagtcactgcagatgtggtagaaatagcatgagaaccagaatgagaagtggagtcagaaggtgtgactgaatagctgtaatctcaaggtaaaacttcagcggatccagagttgctgcttatggatgagcaaagattgtggtttcatgagatgcactctactcttggtgatgatgctgtgaacattgttgaaatgacaacaaaggatttagaatattccataaacttagttgataaattagcatcagggtttgagaagattgactcaaattttgaaagaagttctactgagtaaaatgctatcaaacagcatcacatgctacaaagaaatcattggctataaaggagagccaatcgatgcagcaaacttcgttgttgtcttattttaagaaattgctacagccatcccgaccttcagcaaccgccaccctgatcaatcagcagccatcctcactgaggcaagagcctgtaccagcaaaaagattatgactccctgcaggctcagatgattgttaccattttttttaggagtaatgtattttcaaattaaggtatgtacattttttagatacaatgctattgcacacttgacagatgatagtagagtgtaaacataacatttaatgcactggggaaccaaaaatattcgtgtgcctcattttattgtgatatttactttattgcagcagtctggaaccaaacacacaatattccaaggcagtcctatatattgtttcatgtctctctttcttctaaaatgtgtgtaggagaaaaaattatatcacttatgttactgggccataatatcaaaagcctgcgaatctgatgcacatgataaaaactggtcttaaacctgtcttgattatcctttgttaatatgccaaatttatagaacaatagagtttcaagaaatgtgaacaatgtagaataactaaaagatctaacgttgaatagctaaaattatcaacgccctttatatcactttagaaatgcgtttgcaaatcattatcaacaaattgtagcataaaattctttttttttcttgactttgaaattgtatttcaagatccgcaatttacaccacattatttacttactggcttgtgaaagtgaaaggcattttcatttttggatgttaagggttttagtaaatgacaagtaaatcaatcctttaagttccgtgtggtataatagcttggaaaggaccatcttaatctttttttcaacacagggagataatttattttaaaaataacacactaatagtagattaatattattaccatttcaaagaagtcaccaaatttggtaggcttaagaggttttttttttttttttgagattactatgctctttttttattttatttattttatatttatttatttattttttagttttttaattttactttaagttctgggatacatgtgcagaacgtgcaggtttgttacctaggtatacatgtatcatggtggtttgctatactcatcaacccaacatccaggttttaagcccccaatgcattaggtatttgtcctaatgctctctgtccccttgcccctcaccccttgacaggccccggtgtgtgatgttcccctccctgtgtccatgtgttctcattgttcaattcccacttacgagtgagaacatgcagtgctaggcttaagagtttttttaactccccaaaatatcaacaaattgaaacattactacaaagaaatagagaaataaatttcactgactgtcttattgttttttaagtttgaatagctaataatgatttcttaaacagctatcatattttttatttttaaagctagccaaatgatcagtgatttttataatactgataaatactgcttagaaaaggaacatgtgttctagcaatttccacacatttctgattctaattacttgtttctttttgttttatttttatatttttaagttttgtgagtacctagcaggtgtatatatttatttggtacttgagatgttttgatacaggcatgcaatgtgtagtaagcacatcatgtaaaatggggtattcaacccctcaagcatttattctttatgttccaaacaatccaattatactcttttaattaatgtaaaatgtacaattaaatcattattggttatagtccccctgttgtgctatcaaatagtaggtcttactcattctttctaactaattttttgtacccagtaactatacctacaccacccccacctccccacgacccttcccatcctcaggtaaccatccttctactctctatgtccatgagttcaattgttttgaattttaaatcccacaaataagtgagaacatgcaatgtttgtctttctgtgtctgatttatttcacctagcatactgacctccatttccaacaatgttgttgcagatgacagaatctcattcttttttgtggctgagtagtattccattgtgcataggtaccacatgttctttgtccattcatctactgatggacacttaggttgcttccaaatcttggctattgtgaatagcgctgcaataaacatgggagtgcagatatctcttcaatatactgatttattttcttttgggtatatacccagcagcgggaatgctatattatatggtagctctatttttagttttttgaggaacctccaaacggttctccatagtggttgtgctaatttacatttccaccaacagtatacaagggttcctttttcttcacatacttgtcaacattggttattgcctgtcttttggatataagccattttaacgggagtgaggtaatatgtcattgtaattttgattttcatttctctggttatcaatgattcagtgatgttgagcaccttttcatatgcttgtttgccatttgtatgtattcttgatctgccacaagtctctaattacttgtttcttgtaccactgtttcccttcattgtagtcagtgatttggtcaatcaacactttttacgtatgggtatctgttaactgtatttctaggaatggaccaagaattgagaaatttatcccaaccagaaagaacaaaatctatggaggcacaggattactgaaagctttgctcctatagcctcagtttttttctgcaagttcgctgcttcccagttgtccttgtgataaaattcaaaacctcaaactgatttttaaaaagccaactatatactgcttctactatgtctacctaaacttatttgccattatttgtaaagaattccaggctctaaccagcccatttgaggctttattttacgttcatgcctttgttcatgtctgtctttcccttataatgctcttctcattctctagccaaatctgccaaagttcagctgtagtgccatacttgatatgaagtctttgctgagaattcccatatgtggtcatttccttcactgatttgtttcaatagttgttgccattattattattttttttatactgttgctggatactttcgcagatccaatctctaacctgttgttctaccctaggaggttgaccaatatggcagtagcattgggcttgcttgtctattggcttggtccttgtgttgggaggcatcagcagatcaatggatgagaggagagtgagtcgagggatggctaggttcctttactcacagccccagctcctgtcaagaggtcttgtccctgcagccacttctcagattctactaactataccctccccttagcctttcaggccttgaggaggaaagcctcctcatcccactttgaatgaactatttattgcaagaaccatgactgattcagaatataatctgtccttgaatgaaatagttaatttccccttttgtattctcgtttcatatccctgtccctttatccattcctatattatatcatactatcatatagctaccttatattatactatgacatgagtaccttgtaagtatatcatgctatattatagttcttaagtgtgtgggctttggggccaacttacctatgttagaagttctgccacttattaccatgtgatcctagacaaattgtttaacttctttttcattcattttctttactagtaaaataggggcaatattagtacccacctcacagagtaatatgataattacattgactgatagtttttatttaaaacttttattgttcttactatgaaatgggaaatgttctaaacaccttacaaatattaactctattaattctcataatgaatctgagaggtagagactcagtatctccatttcacagtgctggaaatgatacagacagcatttaagtaacatactgaaaatagtaaaccgaataggtggcagccagtatgcaaattgggaaagcctgactccagagttcattcttttaactagtatgctgtgatagactcttttggcatatggtatgcactcaataaacaactattgttgttgtcgttagcattacttcccattgtattattacacaaaaaataattgtttatgagtatttgtttgctagattataagttccttgaaaaaagaagacaagttttatttgtctatgtgtactagctgagtgcttggcaaatagttgcagtttagtaaatgtttctaaaacaaattattagttgtttcttatgtatttcccaagtctatcctagccttggaaacagctaacacttagctaaacctagaaatgtcatttgagatttcagcagccatcattgttgctgaagccacaggttctcctttttatctccaatttcttcctcagatgattcaccactttctttgtcgtttccctacttcatttttcctatagtgacttttgttctccaataaccattgatagtgatgacagtcccaccttggaaccacttctaactgtcctgttcagcttttcctgaggccagatttcccccaaaatacattttttagcttcataactgctccttccagaaatttgaaacgcattctcaggaattaagcaagaggcatttgattgacgtcatttaatttgtgtttaaatgtgttcttcccatcaacgattaaccagtgcttcagccaagatacataacttttattctccactaaccttagggttgaggtcacaatcaggtacgtaatctgtagagcccagtgaaaaatgaaaacgcagggcccttggttaaaaaaaaattaagaatttcaagatggcaacagtagagcatgaaaccaagtatgaatcccttctaatgcagatccttgtgtaactaactgcacaagttatacgttcaagaagctggtcctggttgaggtctttgtctacctagggcacttctcactcagagaggtggaataatcttaactttctgtcttccgtcatctgaaaacttgccccaaagttccttttgccatctcttgcagcaaacctagtggttgttatctgttaaggattcctggtggcttgctttagtttcctacagttcttgagctgcatgtgttgaatggaactccaccattaccatgtaacacatctgaatactcttattttcctccagttaaattctgcgctccttggaaataatggtcatgcaccctaccttagtgatttctaaatagaggtagtatgtaaaaatacatatttacttgaattgcatcttaagaggccagcccatgggaggcatgaagaaacctatgttactaattaatattcaataattgacagttacacattcaggtagtagtgtcatggaaccatcacgttacatggaactgaagagctgatgagaggtttagggtctaggaggacaaaagtgagtgtattagtcagggcctgaggttatatgtacccagacaggataaaatgggacaatattttattagtggaaatatctatgtgaaagaaaagaaggaggaagccaaggaaggtgcaagagatgttagatcaagatgcaattctgactctgcaaggaagagagagggagagaaggctaggcagaagcatcccagtgtgcggtctagtggaaggaaattttggcaaagctgttgggaagtcattgaggcagagccaggcaaagaagtcccatgtctcccaaggaaggctctctgccttagtattcccaccacacccaatcattgggtgaggagaagtctgtgagaagcttggctttggtgcagtgcaatcatggatttcaaaatgcagtaacaggagtcctcagtcagttaagacccaataatagaaggcctgcatattctcatggtggccacttgggtatgaggagcagtggtgtttaaaactgttttgtataatttaaataaagaaaagctgaggactacttaagcttgattccttcagaagacagtctttggcctttatatttcatgtgatatctttgccatatgctctgataactctccatgtttcccctaccataatacctcaggttgttgcaattgcttttttattgcctgtcatcactactcgtttgttttctctttgagaacaggaattattttctccttcactgctacagcccctgcacctagctcaatgagtgacacaacagaagcacttaaaaaattgctataactcaaatttgggggatattctacaaaatacctggcctctgttggtcaaaactgtaagtgttataaagttcaaagaaaggcaaataactatttcaacttaaaaaagactaaggagatacgacaactaaaagcaatgcgtgagtctggaccagaccaggaaataaaaatatagctataaagttcattaatggggtaattgtcatactctgaatatagagtatggataagattatggtactaaagccacgctaaatttcctgactttgaaactgagctgaggttatttaagagaatgtctttgctattaagaaataaaacctaaagtatttaagggtaaaggggcatgatatctgcaaattattctcaaatgattcagaaaaaaaatatatatatataaaacattacatatacagttatatatctatacacacagagagaatgataaaatgataaataattaaaaataatgtggcaaaatgttaacaaatggtgaatccgggcaagggttacctgggagttctttatcttgcaaatattctgcaagcttgaaattatataaaaataaaatgcatcttataaagtatttattcagtgaataaagaacaaaaaaggctaactgcagttggaagatatttatgaagttggttatgaagattcttaagaagttaccgatggaggtgctagtagaacattcaaaaaagaagtagggaaggttgaccaagtaggaaaatatcaatatccaagccagtataaaatggaaatgagaagtgaggaagtaagtggaagacaatgaggatggttttcgatttggccactctatttggagaggcagccgaatgcaagaatagaagccagaagaagatgctcagtgagatggttgaaagctagatagattacagcatcctcaccagtaaaaccctttcggtaactagaaaggctacaatttagtaccttcctgacttctatgcttattttcttcaatacataaaatggttccgtaaactcttttaccttctgaattctttatattaattttttgaagttgtaaataaaatagcatcagttctacattgttacatttcagcttaattcatattcatttactgaaaatgggaacatttgaaaaatcatcatgggcatttatgctatgtagattgttgatttttatagaaaaatataaaaatatgaccagtttgattttcaaagtcttttcttagacatgtaaatactaagcattcaactcaacatatagagtttttatttgagtattatttaggtggaattctattttaatgaatacaataaaaaattgtaattttgtctaaaagcctaaaatgccctagttataatatgtatgatttcactgtttaacttcctatttcatagggttgctatttataaccacttcactcaactctggggggacttagtgagattaaagacttctgattcactttgtatttgaagaattttttttcctccatctttgctcagctagtggaatccatgatgaattctcatctccaaggggtaagcagtttttagtaaagcccagtagctgacttatgactccttagaaatagcattgattccttccttctcctgtgttttgtttcctctagaatgatagaatccatgtagacacgatccattatcatgcttaggtactggtaagcatgtaatgattttagttttgttcgctttaagttatttgtgtcacaaatatctgggatcatatcagagaaataaataagcacaattagcattctacttgtttgttatgactaaagctaggttgaggaaacagaaaaggaccagaggtcatatgaggatgaagataatactaggaacagcatgtttgggagagtaacatctggtaggggtagcagattgggggcagagaacagaattttatagatggatattttggaggcaagtagtttgagtaatgattagatctaaggtgttttctcatctgtgggtggctcgaaggaatagaggtgaaggtcagtttatttgagaagttctggaattataaaactaagttgaagtcaaagaaagtatagtagcaaataaatagaatacccttaaaaggaaaccaaatgaaaaataatcgttactctcaccatatgcttgtgttcttattagcaagaaattcttttaaccactgtttttataatatcttaatgaaaaaatactgaagcgtatgccatattaaatccctctctttatttctagaaagggaatcaaaggagaaaattcccattctgctatactaaaagaccactaagtaaagagcctattagtgtatgataaatcccatagcaatatacattatcattttacagcttctttgttgaaatgaatgtttgtatgtgttgaccatagagtgggataaaaagttgaaattttgttttgaaatattttagaaatgcatagttgtactgcagttgtgaacctccttagatttttaaggaggctgcttcaaaggatctcattaataatcttctcaggtgcttacaaagcatgtgtctgtcagcagaattagagaatcacccaactagagaacaggtttcacaataccctgagacctattttgttcattagagaggaaaatggcttgttttgagtctaagttgacatgcttgctaatttcagcaataaaagctgttcattgtggtcaggtttaatttagagcctggtaaggttcagattaaagttgatcaacttacttttacaacatacttcttaaatgaactttgaaatcttaaaagaaggaaaaaagtatagcaaacagtgaataatgtatctaaaactgagaagcaaaaaaaatctggttatgtgagagtgaattaaaagaagaacaacccaataaagataatctttgttatataaaaatttccaagtatcgaaaagcacgatttttcatgtgagttacacactataccgaatatatttgtccactgccacatgcatagtccctagaatagtgcctagtgctgaaaaatatttattaaaatgaatggatgagtaaatgaatttatgtattttgccagccctgtgtatttaaagttctctgttaactttgaggtgaaaatttgacttcatctgaggtttctgggtaagtccgttttaaaaattctattgaacatattcaaacattttagggtaggcaattccaaagcaacctttcagcttcccatgtcacagatgaccagagtttcacattctaacactggaaaacatcttatttcataaaatctacctgctactatatggttcctactttaaaatttgttcagtactctccagctgacttatgccacttacttcaatagctgtctttggcaatttgttccatatttcaaacactctgttgtgtaaagaaaccataaaagttagaaacctgaaaattggattttttttctgagcaatcacagcttacaaatgtggaaaatttgttaaaagttagcccctccaatttttcaatacagagaggagaaagtgcctaaagtagatgtacaatgtttggaaaagttttttgcattattttactattaccaaaagcaattgagtttaaatcacaaagcctgtctccctacctcttcacagaagaaacactacagaatgatcaaaatttggcctttccaaaaccaaaattcgttagaaaatcagcaggagtcaaagtacagagtaaataactaagtttcatataagtttcagatacattactatctaccactttcatctcttcatcttcattggcctcatgtggtagaacatcatatttaaaattatacaaacttgctggcttgtttactagtgtggttattataagaaaaaaatgagaaaatatagataaaacatctgtcacatattgcttataaactaacagtaaatattacttgtattttccccaattaaaataaaatttactgagttttagaaccagagctagtcagatgcctttttttcataaatttcttcataaatacctctgagattgtggtccttaaatctagagagactaagatgacagagaaaatagacactgaagaaagggaagaatatcttaatgatttacattactacctataaattaaaaattgttaactttattatatttgtatttttatttaaaatagtgctatattaaagtcatttataatacaggggaataggaatactaacctgtaatctgatgctctccaaacttgcctaaatcataaaagttaattagataatttatttaaaatgcaagatttgcagccctttccactacatattcattagttctggagggaggcaaaaaggtttggtgattcttacggacaggcagcttaggagaaaagctgatttagctcgtctacttcaccttttcatttgacaggtgagaaatctcaggggtacaatgaagttaaataagtaatatctcttaaatcggttctgtgctttttctgtttttaaaataaatataccttaattttgacgtcacacagaatgatattataagtataaatagttatctatcttttaaatacattgtcgtaattcagaataacatttcttactcaaggcattcagacagtggtttaagtaatccgaggtactccggaatgtctccatttgagcctttaaatgaagaaaatctatagtcaagattttcatttgaaatatttttgatatctaagaatgaaacatatttcctgttaaattgttttctataaacccttatacagtaacatcttttttatttctaaaagtgttttggctggtctcacaattgtactttactttgtattatgtaaaaggaatacacaacgctgaagaaccctgatactaagggatatttgttcttacaggcaacaatgcaggatttggaacagaggcgtccccagttggaagaactcattaccgctgcccaaaatttgaaaaacaagaccagcaatcaagaggctagaacaatcattacggatcgaagtaagttttttaacaagcatgggacacacaaagcaagatgcatgacaagtttcaataaaaacttaagttcatatatccccctcacatttataaaaataatgtgaaataattgtaaatgataacaattgtgctgagattttcagtccataatgttaccttttaataaatgaatgtaattccattgaatagaagaaatacatttttaaatcaattcagggcttatatagttgcaaagcatgcattgatgggtgtggtgaccacagtgtggcagaacatttgtggcagaacatttgttctttagttgtcatctgggctggcatccatggagatgccagtctctccctcatatccttggctgttggtccaagcaggcagtggcttcttcctgggccatctttcattcccatgtgcagtgactttcagatctggatatctctccgctactttgatgcccccattttgtaatatcaaaaatcatcgtactgtaccttatgccgtagtagggtgggcaggaactttggtaagacccatctgactagacgctgtgcatattcttttcttctgacatacactcctatccatttaatggggagagtgattcgcagtgattgtgtgttgtgtcagtgagtttccatggggtcaggaagagtgacagacgaaggagtaggggaaactcgccacccggtttccctcagagattctcctcagaaatgaggtccaagtcagctctgctttcaggttctctcagatctctctcggtttcttcacttctctctaccttccttccctccagggacacacactggtattgaattttcttgcttcctctgcaatatcccctcattttccttcccacaacccgaagaatcctttgtagtgcaggaaggaggaaaacctttcagccatctttttttttctctttgaaatcttttgtcttttaccaggcttagacttttcaaactcggaaaccatgagagtctatatcttcataatttatattctgctatgttaacccttccctaaggaaatgactagttgtcaatatgttggggaaagtgaaagagtaaccagagtaaaaggttaatattttaaaatattattagtcatacttccacatattgggtaagtacttattgataatagctagtatttattcagtacctcataagcattagatggtgtgtgcacatgtgtgtgtttctgtgtgtttctgtgtgtgtgtacaaaatctttacagaatcttgtgagctatattttataatccccattttatagacgagaaaacaggttccaagaacagttactcggccgggcgcggtggctcacgcctgtaatcccagcacttggggaggccgaggcgggcggatcacgaggtcaggagatcgagaccatcctggctaacacggtgaaaccccgtctctactaaaaatacaaaaaaaaattagccgggcgtggtggcgggcgcctgtagtcccagctacttgggaggctgaggcaggagaatggcgtgaacccgggaggcggagcttgcagtgagccgagattgcgccactgcactccagcctgggcgacagagcgagactgcgtcgtttacaaacaagcaaagaacagagcttggaatttgtaaatgtctctttctgacttgaaaatctgcgctctttctagtatgtttaccatttcccatcttgttttgttgcttttgttaatgaccttaatcattgtactaagactaaatacttcttttgtctgaaattatgtatgttttgattcacttcctaaagacatgtcttctttcagttgtagtgattgctaattaaaataggctgttcttggttttgaaagtttaactctttattgttgcttaaacaatgaatgtggatgtatgctaatgtattatttcagtaacactagccactataacaggtaatctcccaaatcttggaggcttactacagcagaaatttacttcttattttagtgcagtccaaaataagcagccctctatgaagtcattcaggaacccaagctccttccatcttttgtgtccagagcataagactcatatgcatttaatgggcagatgaagaatgagtattactcatgaaaatttgtcatgagccacgcctggaaatggtgtgtgttaattttgttcatattctgttggatggatcttgtcacatggtcacacctaactgcgagggaattagggaaatagtgtacactgttgagcctaggaagaggaacagatttggtaagatagccatacaattgatttagcagagcattcctccaccatactggaaccttgagggttctccaacaagttgcaacacactgacccaaaagagtgaatcttagtgagtgatttactcaatatgagactgaattcccattacacaggtaagtgatcagtttcttgcctgagaaatatggaaatttggcagtgaggtttatgcaaatctgaacatactatacagagagtcatttgttattttactaatgaaaaatcacttcaattttttccctaagaggaagacaatatgaatgtattatacagtatttgttcaacattgtctgaacattttccattatcccctgcatttttttttcatattgcattgactttttcatgatagagattaaaattgaatgaccggagggcaagtttgtatctctctgccaatattcagtgatttgaatagttcttcttttctaagcttttgtcttttaggaatgaatacctttatgaatatttgcagcctagtggaaaggctgtaatccaaatggtccaagaaagcattttcttaaaagcaagtgtctgtcgagatgtgtcatagcgcttattaagagtctaagctggaatcttagttccaaatatgcctggagcctctaaatggtaccaggataattctgacaagatatgtttatctaaacaatgtcatttgcagccctgctacacttcagtttatctctccctttgaaatctataaaatgggatggaaattcaatactcataaacttttcgatcgtgttcaaaatagaatttttcttagtaaagatttggttttcaggaaaaggacagaaataaaatacttgctcataaaattgtattttctcatttgatgattttggtcttcctttttattgccatgaaacttctagaaatgctcaaaaagaaatcagctaaataaagaaaaaatagttaatatatgtatgtaatactatattgaaacatttttctttctctggtaaatcccatttcataactttgaacagttgggaaaatctatacatagttattgcagtctatcaagagaaaagttcagtacaaagctatttatgtctactagaaatattcatgttaaacttcaagtaattgggtgtgcaagccaccaccatgttttactatatgaaactattaccgtggtatctgttgtattcaggtaattatattgatggaaatcatgcagtaataatctaggtaagagagtaaattttgtctaaatcagatcaaatgaaaaattctccctctttctaatattcgaattgctcatttttctttaactctttggtgtctgaatttgtcaatcattcctggccattttcttctgcaaaagggctgggtcaggggaccaaaagcagataagattagaagaatttaaattttcttccttggaggcgtctgaattacatgaaactcttgttcgtgtctgttaatactgcaaggcataataccataataccttgcatagcagtgaagaggatttggaaagataaaactgcttccttttatcattctgtttatttcacaaacaatattggtgaatgtcgttcctgtaacatttggatttaagagccttgtttctgtagcttctccctccgtaacccccaccactaccatttcggggctatacagcaatagcatgcattactttaaaaggcaggctgcctagactggccacttgttagctttgtggccttgagcaaatgactaatctcagtaaactatctgctcttagtttccttctctgtaaaataggctcacttataactatctcatgggttgggaggattagatgaaataattaatgtagagcccttagatcagggccatagtaaaagctgaatgaatgttagcatttgttattttaattataatctattggggtgctttgaaggcttaatgcaaaatacttaatgagctttttggtagctgtttagttatttcgccccccaccaccaccccaaaaggagagatttaaaagaccgacaggagaaggttgcttggaaaagatggaataagatctataaatagaattaaacaaatattcaggaaagccttttgtgggaaatactgcaaaatttttattatctataaatttaataggtagataaaattactactcccattttagagacagaaaaccgagactcggagagctaacgtaacttgtctagggtcttaggaagatgacaagtgaggaagtagaattcaagcccacgtctatatgattttaaagcccgaggcacatcaaatggaaaaggctggttagtcagaaaaataggaaggtatatttatctgacaacttaaaatattaggactaacctcaggtaattatagtctggatatacatttttgctgctcctgtttatacttttgacttctgtgtatttgagtgtctaatcaaaggattgtcttttacatgtgttggagatgtacagactagtggaccccaatgatctattagctgtgtaaccttagccaagttaattctctttcctaaactgtggttctctcatctgtcatgtggggctaataatagtacttatgctggtagggtgattaagaaagtaaaataattggtgtttctaaagtaaatatgtggcacatattagatgctcattaaatggtacatattgttatggtgagatggatttggtacagagagaactggagatgggagaatatgaagggtgtataatgtggccttttattagctaaaccaagggaaggacttctgaaacagaattccaagttttaagagggagtcgtttattttggaattattttttcagctaaggatttttcaacccagtccagaattcttagagaaatttagtgatagcttataaattttaagaaaaggaattcacattatattgcataaagaactggtatacagggccatagaaggggagaatgttcttctgtatgagaataaaaaaaaacatctctcacacgatttttgaattaactgacagttttatagcagctttgtcaacccatcattcattgctgcaaccaaatctatgaaatccttcatggcgaaataaaaaggctctgttgttctccacatttgtatgaaatctctgttgctaatgaaatgccagccagtatcttcctctcaggtattgtctattagatggttgcttattttagaagaagtggagtcaaccatataaatttccttcttttgacatctagcacctgctgtcaacctgttatagctacaagcagctctcaaaattcacatccactaggatgccgctggcaaccaaagagttcagttcagttcagcgaacgtttgaatgcctactctgtgctatctaatatcagagatggtagaggggatacaggaaaaaagtaagattcagcctttgtctttaaagagctcacaatcaaatgtgggtatttggacaagtatatttaggcaaggcagtttaggataggtgcttcagtagagcagtattacaaaatgttgagagaaaactagaggaggagttttaaatgagggcttagtggaatgcttccaggaggaggctgaatttgacctggtcatgaataagactttgaaaagcagaaggaagctggagagggaagggtatttcaggaattgatgacaggagaatacataattagacctgttaacagtggggtggaagacgaatatcagcatgggagtgtgtgtgtgtgtgtgtgtgtgtgtgtgtgtgtgtgtgtgtgtgttgtggaggataagggagtaaatgaagtcagtaagaccagttagaaggcaagagagcccaagctggagcagtgaccatggagtaaaaagaaagaagtgaaattgagacataaggtggagctagaattaacaggattttgacattgattgcatatataaaactgtcaatctaagagaaggcctgcctctaagagttggagattgaattctttggaagattaatgtcataaccagagacaaactcaggataaggagttgattatgggagacaaagtaatgtgcttaacatgaagctagatgaccatactgagattttaaagaaatggttgaaaacatagagattgcaggagtgatgttacttttggacaagaattcaaaagttacctggaatgtctgagcttgcacagagagagggtacctggtgcaaagaaaagtgaacctaggaaaaagcctagaagttggtttacatttaaggaatttgagaagaggtagcaccacccaccccccacacaacccccaaccctgccaacttacaatatagaagcatttagacacacactgaataataattttttttttgagacagagtcctgctccattgcccaggctggagtgcagtggtgccatctttgctcactgcaactccgcctcccagattcaagctattctcttgcctcagcctaccgagtagctggcattacaggctcccaccatcatgcccagctaatttttttgtatttttagtagggacggggtttcgtcatgttggccaggctggtctcaaactcttgacttcaggtgatccacccgcctcggcctcccaaagtgctgggattacagacctgagccaccgcgcccagcctaaataatgaatttatagatgctacactgtatggtttcctttttctgctgctgtacaaccattcaagtaacataagtttcatcctggttcttaatgataccatgaataaagtatagaaactctttagctgaggattaaagattgttgtgtttaggtagaccaggtttctgatgcagccctcagtataccagggaaattagccattactgtttgccttgtaggtctaatgaaccctttagctttttattttgtatatgtctaagttactctacaaattcttatggaagtataaagagatagtgaaagacaatcttatgagaaattttaataagaattgaaatacaggctgggcacagtggctcactcctgtaattccagcactttgggaggctgaagcgatggatcacctgaggtcaggagttcgaaaccagcctggctaacatggtgaagccccatctctactaaaaatacaaaaaaattagccaggcatggtggcgggcacctgtaatcccagctactcgggaggctgaggcaggagaattgcttgaacccgggaggcggaggttgcactgagccgagatcacgccattgcactctaacctgggcaacaagagtgaaactccatcgtaaataaataaataaataaataataaaaaagaaatacaacttactttttgtatcaaataaattttggtgcacaaacatcataaatgacataatatctgtcacacatcctttagcaaaacaggattgttaaaattcttacagctaatattatgtggtgaagttcttcctgttgaataattaagtggattaaaatatcatatttcctttctgtcattagaaatatattgtgcattaatcagtccttgggcctgagaacatttatctaggttttcatcatctgaaaactcacagtccaatatttcacctgtattatcaattcaccattatcattagagtttagaatgctgctgtctctttccatctatcttctgttgtatctaataattaggagatatatatatatatatatatatatatagagagagagagagagagagagagagagagagagtgagagagagagagagattggtaataatactaatatatataataatattatatatatacacacatacagagagagagagagagagagagagagagattgattttaagccattaactcatatgattgtgggagctgaaaagtcaaaaatctgtaaaatccaaaagcctggcaggatggagaccaagggaagagttgatgttgcaatcttgagtccaaaggtaatccgatagcagaattccttccttttctggggacttcagtcttttctcttaaggacttcaaaattgattggagaaggcccacccacattgtggagggtaatctgctttactcaaagtctgctgattgaaatgttaatcacatctaaaaaataccttcacagcaacatctagattggtgtttgaccaaacaactgggaaccatagcccagccaagttaacacataaaatttaccatcatcagccatcatcatgaggttcataatgtcatgtgtttcttcacatataaatctcgtggttcttttatttttttagtagtacctagttaataaggtacctggaaatatacgttaaataatagaaatggtctttaatatcttaatgaatttcagagttctatcagagtaattgtaacttgtatataaaaactgatatataaaaaacaagtatgttttttcttcctatacgttgtgttaaattaatactaattacctatcatgaaatgaatgttttccatttttcataaatgtatttcatttttaaattaagaggattaatatcaaaacatatttgaataggatttaaaatccaaattacctgttgcgattatatttaattataaatctttcaagtgagtttataataggaaaaatattttttattaaagtgatgtaccataattatgaacataaatagtgttttctactaattgtttttgtcttcattatgtttctttttaaggggaaagatctgggttaacaaatgttttattcatccaccttgaaaattaaacataataaacaaaactattaaataaataaaccaattaaagaaaatagtttttcttccttttttgtgataaagatgattatgagtaaatatattaaagaattttatactcagacaaagtgagctaataagacaaatacaaacagagatgagcccagaaagagatactctacatgtttataggctagcatttttatcttatgacctacagggtcattgtaactaaagtcttgaatttctgttatattttggtacctgtgggcataaataggaatattactccctgatggcatcatgcattttagataaaactaagccaagggttaaacacgtgccatggactgttcctaaaaaatgctctcagctctcaagttatagaaaattgtagggattattattttgtacctactacttctttctttaccaaaatttacttatacatgatttgaaaattgcttgccacctgtctttattctgttgtacttgtcttaagtaaaacatttataaagtaagtaggaaggattaatagattgtgacctttctacatgaaaaggggaaagccgagcttgttctacttttgtcaggaaagagtttgaatagttacctgttactgtaaaacaatcaccccaaacttagtgtcctaaagtagcaataatcatttattatcactcataggttctgtaggtcaggattcatgcattgcttggttgaggggttctgtctcacgatcactcatgatgttgcactcagatgtcaattaggctgcagtcatatgatggcttgactggggctgaaggattcactttcacagtgagttacttgtatagcttgtgagttggtgctgtctagttggtttccctctaaacgagttcctccatgggactacttgagtgttcttatgatgtggtggctggcttaccccaggacaagcaacctatgagttttgccctgagttttctgaaacatgatcccatgttgctttgaatatccccattagacactcccacaaatgtcaatcatactctttgccctaaaagttgcagactacttgtacatgtcctttatcctacatgtgtacaggaaacacgtgcagaataacatgtgtttttgtttcttgaaagaaacaagaacccaccaaaactttatagctccgggacatgatgataattatctcaggtccactcagcctggctccacatggaaaatatgggtattgtaaagaaagcttttgaattttggaggcctaacaaaaagacctaggaagctaatagttggttatgagataattataacaatggtgatgaaagcaattgcgattattacttttatgttagtgagataaatacataagaatgtccttctttaatttcattccttaatttccttaatccccattcttgatttctggattagaggaaagctatactatctacctgattacacaaaaagactggactgaggggtaaccattaggactcttgttagttgaaggtaataaactatattacttcagtggctaaaacaaacaggagcttttttctcatataaaactagaagtcaggaaacaaatggttgctgatgttggtttatccgtttgacaggttctacctttatcctggagattctttggcctttatttctttagtaatatagtagtaacagcactgaatctaaaataagagcacttggtccaagcactggctctgcccccttagtgacagtgggacccatggcaaattatttaatctctccaacagttaattttctcatctgtaaaactgggatcctgataacttccatactagtttggtgttaggattcaatgaaatgacgcatggaaaagtccttttcaaatggctactcactatacaaatattaatgtcttagtaagctcaggctgctataaaataatgccatagactgggtggcttaaacaacaggcagttgtttttcacggttctggaggttgagaagtacaagatcatggtgctgacagatgtggttcctggtgagaaccttcttcttgctgtatcctcgtatgttggggagagaggtggtgcagagaggtactctagtctctcttcttgctcttcttaaaaggacactaatccaattatggaggcctcaacctatgacctcatctaacccttattatttctcaaaggccccacctccaaatatccattgggggttagcacttcaacatacaaattttagccggcgggggggatgccagcattcagtccataacaatcaactatcctcattattgagagttccactaggccttctcaagggttgacaatgatagtgccctgctagctataagagtaaaaaaattttcacatctagaaaatgggtgcacgaatattggtaactgttctaatgtctatgcacagaatttttagaacttgctcgagaaatttgtctttcctgacagtgttgcttctcttaaattccagtcgagggccttgaaaaaaataggttttccatcaagattctctgaatgaataaatgaaatgctctgatattttctttcaatattaagataaagcaaaatgtatacagaattttctattttcagtgtttccaattactgcatggtttggcttattaccatctctaagtctaaccctgggtcataggagtaaagccattgggggtcccctacaaaggatacaaggcagtggtagatacaataagcctgacaattggagtcagatttttctctttcatacaggaaccatggaactgttgccctgggccacagctggctctcagaaaaacgtagaactggtcgaggaaaggaaaggcagggagtccttgattcacttgttatcagaaaattgtctgttcaaacaacagaatgtttgaaaagataaaatcaagtctcaaatgcacagaataagaatgaggggaaaacacctttctctgtaattaaacagaaaagtgtgccatgaagtgataaaacccagtcaacctgaaaatgtgaacatcaagtgtaattgtgcagaacgataaggtaatatgaacagcacaggaatatataggctcacgttggcattttaaagcaatggcactttacctgttcctcatgaaggatttggtttagtctaatcccttgtaggagccactaagaggagaaggcacagtccttttgggatgtaaaatggggaattctttctatgattacaagaatttgtaaattgctcagagttttaggacagcaggttatgtgtctctcaatgttgggtaccatgccaaacgtactttaagagacatagcaataaatagaatgggattcatttttttcttaatgtctggcagggcaaccaaaatgcccacgtttcccttcagtagcttggtattttggtaactaaaaacatgttccagggaactccagaatatgaaacatttcagacaatttgaaactgtcaaaattttcacttctttatgggacaaataaaatctaactttattcagattttaaagtatctcataaaagagtaatactttagatttgtgctgtgctttatacgaattggatgaggaactcttatacatatataagtggattttattttcacaacagtccctatggtagatattgtccttattaagtaaatgagagaaccaactatcaaagatattaatattttgcataagatcacacagatagcggaaccaggatttaatccaactcctctgattctaaaaataggtgttagatgggtattctttccccaaacctatgctgaaaggaggctacatttggagtcagttattgaaagtttaaatatatgtgtatatatatatatatatgtgtgtgtgtgtgtgtgtgtgtgtgtgtgtattcttatatactcatgcatgtagatagttataaagtacatgcttatatgtcaattttatatatacgactgatatataaactatcaatttgtgatagtttatttcaattaagttcaaacatattgggtatttattgactcatgggacttaaaatttctcagaggcattaatttctatgcctttaagcaaaataatgtttagcccgttttagaaagataaaaggctaacatatgttttgtttttgtttgttttgttttgttttgttttgttttgttgagatggagttttgctcttgttgcccaggctggagtgcaatggtgcgatcttggctcacagcaacctccgcctcctgggttcaagcgattctcctgcctcagccatctgagtagctgggattacagacacgtgccaccatgcccggctaattttgtatttttagtagagacagagtttctccatgttggtcaggctggtctcgagctcccaacctcaggtgatccacccgcctcggcctcccaaagtgctgggattacaggcgtgagccacggctcctggccgctaacacatgtttttaaaaaataaacaccattcgagtaggaaaagtgggagaactggtggttcagctagagatacggagatgggagggcaagttgctttctcatgttgccacatctgtaagttacaaatgccatagattaggaatttcaacgttgttgtgtctctctgaggacattctccatgtagtatatgtttcgcctccctgatggacagtaagcatcaaacggttactcctttatatttgaattattttaattctaacatcttgttctgaaaataacgggaatgccataaatacttactgattgattggactgtctcgcaggggagctggcagctagtgtaggctacaagctgccatcatcatctccatgaccatgagtcatcactggaattaccctaaagaggttaataaaacgccttgtttgaaaagcaaacaaaaagccagaagaaacccaaagcaaacagacccagactttgcaatgggtagtgaattttcagtcttaagggattgagagtccttttagtacaatctctcataaacatataacagattttaaaagcaccttggtctgattccagttcacatacctcatccttgcagaatacaacatactaggccatttgaaatgttcctcagtttacttttggaggatctgctgatttgagcaaaatggaaatgaaatgtatatagaaagctcttaatttttttttttttttttttttgagacggagtttcgctctgtcgcccaggctggagtgcagtggcgggatctcggctcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagctcttaatcttaagaagttcagtttcgcagctccccccccaccaacccccaatcttgaaagcaggaatttggattagggttttttaataaaactttctttttcttattaccatgatgttttttgagagggtacagagaactcattaaaatgttatgttataacttaagacaaaatgggaatgagaatttgcattatataaacaaagtgtatgactaagtaacctgttacatataaagtgtttgactaagtaacctgttgtccctaggagaagtagaataaatatcaacatgtggcaactaacagaatgtgttgtgatcactaaagcagcacattcattgactttacacttcattaagtaggtaacgaattttacaaattttaggacttaaccaggctgtccataatactttgcatcagtaagtaccaaaatctacgatagggcacttcggagttccttaatttaataatattgataatattttgtttacattttgatttaattgtatcatttcattatttttgtgtcctgattctaaatatatacgtcaacaagctatatggccattcaaaacaggtaaactttaaatatgtttttgacatagaaattatgtaacagtcttcatcatgagtataggagtcagatttccaattgaaaatttcatcctctaaaatacttggcatatgtatacagttgtctagttcagacaaaaaagtattgaatataaagttgattttgtaaaaccagaattggcatccttaaggaatacaaataaagggaatcttaagataatataataatgctgatttgaaatgaaaattaataaaattgttattctattttagtatgctaaattggacagatccttatttcattgaaaaattagattcttcagtatatcagtgcactgtgctaataacacaagaagattaaattatgtccatatgtgatttggtagaatttaattataaatataataaatccttcaatatgtacagcagtgaatattccaaatttatctctcatataagttgtgagcaacttaaggataggcaccatcccttaacatacctagattaagaacagtacctagaaaacagtcatcaaatgcttcctaaataaattttcaccttcaagcttatggcagcaaattaaacatagattgacccttttctaatagagacagaatagatgagactgatgacttttttttataaatgtgtaagtctgcaaatatttagtaaggatctaatttacacaaagaaatcaacctagagtgagattattttattcatttcccggaggctgtgactgaattatatttgcaacttgccctaatttttatacttaataatttgcattagtatttaaattatgtgaaggaaaaatataagtttaaaatactgaaaagtatattcacacattcatcaaatgttgattatgtgcttacagtgtgcaaggtattggggctaggaattatgtggtgttccaaggaaaccatgatacagcctctttcattacagtgtttattattaggtagaaaaagtaaaattagtataatattagataggatatatgtgtcataggagtaatataaacaatattttatgaacaatgtatgaaggtataattttgttcatttatccatttatcgctctgtacatccatccgtttattcattgttcattacttcatttaataatactttagtgaccattggaaaagggatttataaaagtgagtaaaatgttaatcattttctaaagaagttgataatctagggaaagacaaatgtgtaccaacaataacttggatataaagcataaattagaggtacaagcaaagaaaaatgaaagtacaaaggagaaaaatatttggctgcatgagagcagggactgtgtcttgtttcatcatagattttccagaacctagatcagtgtttggcacaaagtaggttcagatgagtttgtgttgactgactgtctactgaagtaattgtggaacatatcatagaagaagtagatcagaggctggatcttaaaactgggagaaatacatttcagctccgtgaaaccccagaagtgatatttgacattagaaagcacaaagtcacactctaacagtgacagtactgagtgaagtaagaattttctgcaccccttcttcttcttccactcccattaacccttgttagggtgagaaatagcagctggtgaatggtagagaagactagcaagacagaaagaggaagcccaccatgcccactaccccaggtagtaaaggacctgtccacttccatcctcttctaattgaggaagaaatcatatatgtgagttcagattgaagtattgattaatatattgagctggatattctaattttaatgtctcgatatggagcaggactttgtttccttaatgatgaccagaaaagacatgaaacttacccatattttcacccaagaacagaacagaacaacctacttgaacagatttaaagggagaaccaaaggcagataaagttgtctttattcttacacagcataagtcctgattattcatcaatttatacattttatgaatttaagaaaaaaggaaaggaagactataaagggattcatatcaggatacacatgaaggtaatgtagtcagttttttagtggaaccaaaatattacagtcatcactgaacgaaaatattacaatcattacatcattcactagattaagtgaataaattaaaaatatattaaataaaattaacaaagacatgagcttttcaaagtgtgtggtaacctggagcaataagcagtgtagttggaatgttacctcttaaggattatcaaagaggctggctgttcagtaggacagtggtatggtaaagcaagcttgctacattgcagaactccagagggcaacattctaattatctttagctatggggtctgttcccataggataactataacttagtaggttgacagagcctcccaagaaaccacagcagtgctcaattgtggcgaattacttctctatcccatcaaaatgtcgtgattggacccacaactgtgcatacatttttttggcattttcctgccagaagcatatttacatttctttaatatccagtcatatccttcccttatttaaaaataattattcagagaattccagttttttgtaatcctctcttctatgaattttagcaacacttatatacagatacttgatattctggagaaatatgcttcaagaccatgtggattaacagattttcaaatgccgttatagtatatgtatatactatatatgtataagtatgtgtagtccccaaaatgcgtactttaaaatcctcataatagatctcttacagatgaggaaaagaagatgtagaaaggttacataaagtagctaacaagtattccaaataatattgaacttcagtctgactattccaaaattgcattcttaactctgatttctatatttgttttccattctaaactgtgtattgtgatataagttcctcactaaggctctttttcagggtcttcctaatactaaagtcactcttacaatgagtattttctttacgtgtgaaatccaataggcaaaaaaaaaaacttggcaataaattttaggcattaacctcatgccaagtaattatcagaaggctgtaatgctttgaaacttcacaagtctgattttaagataatggaatgaggcttgcattgtgaactttcttgatgctttacattgcaatatgctgtatagattgacttcctaaaaataaaaaataaaaaaaaagatttgtagagcatactgggaaggtcttgccaattaaaaaccggagattggctgaaggcttgcagcaattgaattttgaatacagatggtgtcaaatcgagtgtttccatagcaacagactcttccttaataacttttagatgggagggggtacataaaagagaaaaccatcttttagcagatgtatgttttcagcatgttttcagattgattttggaagctaatttgtacttaactagtgattgttttaagtggatctaaatattactaaattctcctgaggaaacattttgagaataacagaaataaactctaggaactttataaagacatgaaaagggcacaattttacaaaacctttttttttttggtctggagccaatcaaacagtattttatattgagtatgacctatcaatagtcaaagagttcttgattcttaatgcctgttaatattgaatgtttagaatatgggtaaaatcaaggaaaaagtgctatgtatctcatggatttggaatatcttaatatactctttcttcaggttaatgattatttttaaaaaatgatgatataaatcatttcaggaaggactgcataaagaggtcattgatagagttcatatcatatagcagagttgtcgtagatttaatgtccaatcctcagttttgcatagccaacaactaaattttagtagtttacctagagatgatcaggctctgggagactgattcatgctacacaaactcacaaggcactggtttataaaccatttgaaagaagaaataataattcaaactattattttacaacaagactggcaggaaaatcaataatggtaatgtgttcggggtgtcctccccagtgaggactatccagaagaccaaatgatagattattgttcaaagtgatagaattgggagaagggtaataaagcattatgaaaggatgcttccttaagtgagaaaagctacataaactacccatctttactattctagatgaccttaaaaatattaatagaaacagagaaacagacaattcatctcagatggtacaaaaaacataatagcacatgtttgctccctggcttccttttagattccctgcaagaggttttcccccaaccaccaccatatacagatatacagctttaccttcactctcctattatctgtcacagaacaatataaaactcagatatgttagtataagttaatagttggtagctttatgttaatgacattgctacctgttacccccagattcatctgggttacttcatccccaaaaccctttcaaaacgacatttcccacaaagatttctagtattactggccattcccggacatcttgcttccaacataagaaattctgacataatagggatataagaaggccttgggaatctgtatttataacaagctccccaggctatctgaggctcagccagtttatttttgcagatagctattactatccacaatctcttttatcctattgtaattgcagaagaaaatctttctttctagtttctttgaaatttctggaatgttaggacttagagcctctaggaacttgtacataaaaagagagacttaaagagatatcaaagtagagatagagatagatacagataagtgcatagacatagaagtagacatatataatagaaacatatatgtatacatagaaatagaaatatgccatttagaactcttaagaaatatgtgcactcttaaaatatagtttaaaaatgtaaagaacttgctattaattgaaaatagcataataaacttaaatgaaataaggaccccaaacgcaaatatttctctctgacacaccacacacacacacacacacacacacacacacagacagagagagagagagagagagagagagctgtacaataacaaccaattcctgacccagataaagaaaaaatttttatttatcttctttctcattctattattattttttctagattaaattaaaatggtaattatgtgtaagaacaagcattattgccatataaacaatgcaacaaaggaatcaattgaaaattaagtgaaaataaaaggtacagcttcgttaaagacccagttcttagagcttagtctcaaactctttgtactctgcactcttttcttgatttgactcgattgattgattgattgattgattgagtcagagtctcactctgtcacccaggctagagtgtagtggctcaatctcggctcactgcaacctccacctcctgtttcgagtgattctcctgcctcagcctcctgagtagctgagactacagacatgtaccaccatgcccagctaatttttgtatttttagtagagatgggacttcaccatgttggtcaggctggtcctgaactcctgaattcaagtgatctgtctgccttgttcccccaaagagctgggattacaggtgtgagccaccacgcccagccgattttactctctttagaactgcaaaagtaggaatctagctcatatgcagacattctagaaagtttgatttcaaaagtcttctcaaaagaaagagagcaagagcaagaaagaaagcagagagagaaagcagaagataaaatggcattgtttgaacagggatggaaactgagtaagaaatttggtcactaaacactttagtgtctatcatttaagattgtaatttggttatttatcactggaaagtgattaataatctaaaatgcattttataatactaatactattaaaacattaatttttggagaaagtttattatagattgatttatacttaccactgaatattaaaatgtttaatggaagtagtttcaaatagtatttaatgatatagggaattattacaacattaatgctcaggaaaaaaagtaggatatggaattatttatgccataggatcctaattttgtaaaaaacagagaaaaccagcaaaagaaattataactggaaggaaatacatcaaagtggtttgcagttatcactcatgaaattgaggtgaacttgatttttttccttttatatccatccgtgttttaataccacagacatgctttagatctgcccgtatattgtggctttcagagggtaataaaccattgtgactcagaaatagctaagaatttttatctctcaagaacaaattttcactcccttggggtgtcattatctgttgagaatgcatgcaatagttcaagagccaaaagactctgattcagtaagtttagggtagaaaaaaattaagtacatttttaaaatagagctctggtgtttcaaaggcaatgtgcaaatatacctacttaatattattctaattttttcaggatagctgaaatataaacatctatttttagtaataacacaaatgatggaatgcttttacatatttataaatcattaaggatttgctttttgtttctactgtctggaacatataaatttgaacacaatttagaacaacattcaggaaatatgatttatttattaccttcttgacctttattttatttttaccatctacttttatgtaagtcttttttttcaatcattgtttatttctttacttttccttccacatagaattaaagggagattcgggcttagtgtccttaattcatagttccattgtggctattaaaaggtgaactgaaagcttgcaaacacgtggtaccttgtagataattttctccagtcagacagttagataaaggcctctgaggtttctggggtcattgttgaagctatgttttaaaatcctatatccttctctcattgttggttccttttcacaacacagaagttttcttttttttaatttcaacttttagatacagaaggtgcatgtgcagatttgtcacgtgggagtattgcatgatgctgaggtttggagtacggatcccatcgccatgttagtgagcatagtaactgataggtcgtttttttaacccactcccctccctcctccctctagtagtccccagggtctattgttcccgtatttatgtccatgtgtgctcagtgcttagctcccacttataagtaagtgagaacatgtgatatttggtagaacttttcatttttaagttaaaaaacaaaacaaaatgaggatgagtggaagaactattcagcacagcaggttataaaccaattaggatgatgacgccctgaatggagattttcatgaacatctcatattagctatttcagctttggtttttttaatgttcaaagtaaatagaataatgaagaggctatttaggaaggtttagactgagggaaaaaaatcctttcattaggttccaaataacggttagcttattaaacagcaagaggcagagatttagcagagaaaaaataaaaagatttaaaaaaaaacaacgagattaaaaggtcagtaataccattggaactggcagcatggcaagtttatatcagctatcttttgttttggaacacaactatgctaattctgttctgaacctcttgctaatgcctgtctcaagaaaatttaacatactttatctgtgtgtacaaaaatacctaaggacaaagctattacccaaactgtattcagattgaaagaatccatatagaaatttgcagctaacgtattagtcagtgtatgtaatttctactgcttcacagcacaactctttctaattttcaggagcaatatagcaactgcttgccagccaagagaaaaccataggagcattcttatcattggagccaacattagttctgcctacagtgactaacatagatgcgtttattgctagctggaattttccattggcactagttacatgtaataagttagtgctttcaaatggaccgtggaatataggaaaactagagtctgacgtaaccaaaaaaaaatgttgataaactcagagattatgaaagagaggagaggagtggtttttgtggaaatgatagaaaagcaaaaaaagatggcaggatttggaaaaaagaaaatcaggttagagatttaattagtaaaggagctccttttaataattatataagagtatgagtttagagtaactgcctggctaatatgtacaatcttcaagttcagtcgttttccaaaattctaacttttagcattttttttttgtaaattttaagtggaaatcttccacttttgttgactaacttggctacctgatattttactcaacctcctactttcttgttctctacttcttctgagtctttgcttccacaatgaggtagctcatattccttaagtttcctgtctggttttgcttttttttttttttttaacagctaaaataaactctacaagcatttctatcattttctttacatccaatctcttgtcagccatgtcctaatcactttggtaaagtatcagtgaccacccaagaggttcactttgcttcgtcaaaggaccacctgtcatgctttatctccagagcttctgccttgaaagtaagaataatataacctttcctgaatgtcttatttcaatttcatgcatttgatctgcctcttcagaccattcccaaggctttgcccttgttctttaccctcatggcttcagttattcatcactatatgaatgacagctctcaaactgacagctctggcctctcacctatttcatctattccatatggcaaactgtctatattacatttcatcatgagggataattataattccacattcaacaagaaattgtgggtccgtgttgatttccaacagcaacctttattttttagactatgatagagaaagggtcaactttctctcttacttatttatctcaaataactcaaagtcaagctagaaaagccaagcaagtaatatttcccaacaaagcagctttaagcaaaatgattttcagacacgacatgcagcctgtattgtggaagaagcacagtgacctaggtgtactttgctgaaaagcagtggtcacagtccattagtttcatctttttcctgcaagagagaaaagtatggcagggccaagactcctaagaccccttaaaaaattgtgaggtttttataaccctgttcatttcccatcaaaagcattcatgaagcacctgccatgtaccagatgatgcattctaggcagagggaagaacttgggcaaagtcctgtacattttatcttctaaatcttactaatcttttcttatctttccatctaccacccaccatcaggctgtgcctggactcctatgctaacatcttactctgtttttctgcatcttttttgccctcccctccaatctactctccaattagcaacatgactaatgttttcaagcccagattagacggtgtcacttccctgctttaaacctttcagtggattcccattgcactgaggttgaagaccaaaatctttaccataactcacaaggccactgggagctatgaaaattttcttttttagtttttccttttaattagtgatgcattcaataagtggagtctatcgtgaaagcatagattccaaaggcatgtgaatactcaattatgtaatttacttacagaatgtttattacttcttttttagctttgattttgtatacatcctaactcaatctcagttatataagagattataaaaaagtttgtgatgaatgcatacataaaggaacaaataattaacaaatatataaagacaaatcagtattgaatgaccaaatggctctttatttattaaagaacttagaaaaatatagtcttgcttgagaccaagttctggcaacgtatgtgtgtctttttgtttgggttaaaaagcattagttttatatgttttaaaaggataggatcttcccttggctgcaaatagtataggcaaaatgctattctgtatcttattttaaagaaaataacaatcataccttattatttgctgacagttttgcagtttacaaagcactgttcacatggattaccttattttaaattcctcaattttttttccttttactatgggaattctgtttcaggagaatttccctttaaaattaaggtgattatactattctgttcctgtatttcgtagccatatgtttcaccaaggtattgtctctctccaggtctttcttctctggatgtatagttatgattttccaggaggtaaatgaaaacagtgggagcaattgacagagtgttttttgtttcccataaacccaagcattgcatttaaggagctgctgtactattgtaagagttcctatactaattttaaaagttcatttacatattttgtagatttttaggataagtcatcagaaaaaaattaaaaataaatttacatattttgtattaagctgttttgttacttgaatggggattattggaacgaggaaagaattacttttatctccccatttttcaaatcatttactataacattcatgaattgctgaagtttaaacaatcaaaaatatctgaaaatggagcctaggaagggtaacttatgtctttcatactccttcctttttggtttttctaccagcattttagtctaaaatatattttattttcactgatcctgtgtttgtcttaataatatagtatgtatgttaaatgaaccagaattcattgatctttttttttattattcctctttttgcttttctggagaagcatttgaagaaatcagttcaggctacacttcatcaattcatttcctcatcttccccttaatacaaaagccccattttcactcttcaaaacatttgatcacatacttaattttcatagcattgactaaatgtatgtgtttattttgtttatatattgcatatttgtgatgattttcacttttacagtttaggcatgggtaggaaggacacttacatgagtacttaagttcttggttatgacttgagaaactcacaaggtagcatggaatggcacgtaaacaaggctttgatagggtgaaagggaattatcaggacaaaactgactagtggcagtgacttttgagcagagtgctgcaaactgaaaaggcagagagcattgtaggcagagagaaagcatagacacatgtgagatacatgtgaaatacttagacaaatgtgaggtgtgtggtaacattgtacatacctagggctccttcctgtgtagctgtaaagctggagtataggcatcacaacaggcagcagaagccaagaaactagaaaagtagacaaaggccacgttataaaagatcttgtaggataggtaaagagttttaatactatcctgaaagcagtgtggggtgggaggcatgacattaaggaaatttaataagtgatgaaagaccaagattttcatcttcagaagacttctctggaggtgggtggaccacttgatgtcaggagttcaagaccagcctggtcaacttgatgaaaccccatctctactaaaaatacaaaaaaatagctgggcatggtggtgcatgcctgtaatcccagctactcaggaggctgaggcaggagaatagcttgaacccaagaggcagaggtggcagtgagccaagatggtgccactgcacttcagcctggatgacagagggagactccctattaaaaaaaaaaaaaaaaaagacttctctgactagagttttaaagaaggatggggagtgcaaaaggctaacattaaatcagtggttctcatccctggctgcacgttagaatcactagggggagtttaaaaaaaatgccaatacttggactccaccccaaaccagttaaatcagagccttaatagggcccagacattcgtagtttttaaagcagccctcttgattcaaatgcacagacaaggttgtgttccgctgaactagagagaccatcaggaggcttttaactaaagcaatctagggaagagagagatgaatgatatagaggccagaagagctattaaggagaagtgactcggcatcttcttggttaaagtataaggaagaaagaagaatgaaggataatttgcatgtttctccttcagtgactaagtagaggaacagatgtgtatcagtgattaggggagaggaagaatgaagatgatgtaatccagtttggatatgttggctatttcatagagatttagtaggcgtttggctctatggatacagagttcaagagacaattcttagcttaaaacacagattttactctgattattttagagatagtaaatgaagcaatatacatacatgaactcaccagagagaatatgtaaagtgaaaacaaaaagatcaaagggagacccctagggaatagcaacatttaaggaatgggcctaagagagtgaggagtggccaaataggcagaataaaatccaagaaggaatcttccatattaatcaaaagagaaggtttcaaagagggttcgtcaattggcaggtactgaagggatatctgaaaacataaagactttagactctctaatactgtagcaactttaaggtcactgctatcacctacaaaagtaatttcagtggcaaaagccaaaacgtaatggtttagaagggtatgtgaggtgtggatgtggaaatagtgggtatagactattgcttctcaaaatgtaatcacctgaaaaatcttattttaaaatgcagattttgattcattagctctagagtggagcctgagattctgcatttctaacaagttatcaggtgatgctgatgctgctcatacacaaaccatcctttaagtagcactggtgtaagccactctcccacaaaggaggaagacatagggtttccatcaggggacgcaggtggggtgtaggaccaaaggaaataatactcttttgtcttttgtttggttggttttggttgttttcttcttaaaataaacatggttgtagacggagattgaagacataggaggggtaaaagatggaatcacttctcatagaagatggaagagactggaacattgagtacagcgagggaattaggcatgggtaggagggacacctaaatctgaagagaaggaggtaaggaagaattgaaatacagaaaagttctgtcagtaagcaatgtatggaattgtgctttttagccatagtttctgttcaagaaattgttttccatttatttttatttcttaacttgaatagttggatggtggagtatgcttgtaaaaataagagtgaggccactttgtttttcggggttaatttccgttttctgcactcatcaagtaaaagttgaagtggcaaggtgtagatatgaaattcagtgtgtgctaagggagaaaaaaatgctttttattctacatgattttaaaaatatttatattccaacaaatgcatcaaatttgatgtgcaaatttacagtgatgaatgagttttattgtgtgcattgcatgctggtgacatggtaataaatctgtggtgctagaattataatggtcccctttagcttcgctttaatgaactcttgctgaacacttttgagttgttagtactttatttgctacatttggcacttaattagttaatgactgagatgctggaccgatggatcatctaatgatatgttaggcctattatcacatctagatagtttcttttctgtgacttgtaagtgacctaagatgataaactgaaatatttttgcatagatatacatcaagcttttctcctaacttcaggctttcatcttaagcaatagtttccaacacccccaaaagagaagtcattatgtttttaaaaaaattattcattttaatgtgatcaaataatatcacatttcagcattcacctatttaattaataaaacaacttacatgtttcattatgactggatgttgatattttttcataatctattatcctccaaccagtggtaaaaacccaatcctcctctcacccagctcatctttccgtatgggaagcaatacatacttccctatgttttattaccaaaacaggagaatgagctttctttagaaggttaactcattttctctattagaatattcagcatacttttaaggaggtaatctggtctttgacagtctgttgattagaaaattaagagacctgcctaaattccatttccaactcctctccatacacattgtgactttgagcaaaacgttttgccatttccactcgtataagttctgtttagtatctttaaacttccatatcccacagatggtatttttttcttcattggaaagtggtgttagtgattcagaaaactgcttaaataatacactgctttgtgttttctgtgagagaatttttttttttttttgagacagagtctcactatgttgcctaggctggagtgcagtggcgcaatctcggctcactgcaacctctgccgcccgggttcaagcgattctcctgcctcagcctcccgagtagctgggattacaggtgcctgccactgcgcctggctaatttttgtatttttagtacagacagggtttcaccatcttggccaggttgatcttaagctcctgatctcatgatccgttcacctcggcctcccaaagtgctgggattacaggtgtgagccaccgtgcccagccgagagaacattttatctaacattctattttaaaatttttcaaatacacagaaagctgaaagaattgtacagtgagtgctcatgaacccactctctagattttgttgtatcactttacttctttctctacccgccaacccctattattttctgatgcccttcaaagtaagttggtgacatcggttccctttacccctaagttcttcaacatgcatgtcattaaccagagctcaatatttgttcacatttcttttgtttgtttgtttgtggcaaaatttgtatagactagaatgtgtaaatctcatgtgtattatgaaatgagttttgatgaatgggtatacctgtgtgacacatgcctctcttaagatacaaaaaaatagccttggcccagacaggagggaacattttttaggttggcttgagtttcctttaactgacatgtagcatgactgaatatatgaccataagattgccaagttgaaatttaccaaaggtccatccaggggaacagtatggctattgatacgtcatttgttcatctaggcactgggctgggtgagttcttcacaaaaaccttgtaaggtgagctttcagctctgacagaggcatcaagaaacgtatttcacaaactgttagagctgaaaacatctccagggatcatccaatctatcctcctttgctttatgactcaggatttaagaagccccagaaaagtccaacagtgttaccaaagtacacgattgcctatttacgcccctataattgagagctgtctaggggtcaggtacttttctcagtgccttgtgtacattatttccttttatctttctagattattaattttcttgttattatccccatataatagaggagtaaacagtgtgaaaatagcactaaactgttgatcttttccatgttccaaactaaccttaaatgttaggctaatattataaaattttaaaatttagtcatttgttctgggtctggcttccatgaacttaaccaaaatgcttggctgtttctgcattctagctttttgggatttagagaaaaagcaacttggtcatcatagtggccaggatttatttatgtgccaataactcccctctgtttttagctttttgatctgttacatctcagatactttattctctatttgtaaaacaaccacattcctccttttctatatctaagtgaaaaaaaatgcccgttcatactagctacatggttagcatatatgtttcttcctctttgtgggtttgagttgaaacttcttttgcaaagcttaactatagataggtcttccacagaaccctgtttaaatgccttgtggaagtagaagggacatatcttaatattccttataatctgtgttattatttggactttcctcagttccttatatgtctttgtatgtcaaacattgagttatgcttacattactctaggtatagttgtgtcctagctttgtacaaggttacaataatggtggtttccttgttttcagcttcattcttgatcatgcctaacattttttgatggttttagcctcggagaacagtctactgctatttctccctttttcctgatcccaacaaatagtttagaaatctttgtcttaactgcaattgggatcatttttcctttagagttgcccacagttagtcatgtccgtcactcttcactcactcaaatgacctcaaaagatttacctgcaatttaagcctttcaccttggcattttctacctggaactctggcgtactctgtgggatcagtgagatccatagtgtgcactccctagcagatcgtgaatgtttgttgataactataattcattgtttagtcttgtctatacagagaagcagtagcaccttgctttagtaggatcctttatgcttttattcattattgaattttatcttcacaataattctgtggttctgcagttgtcattatttcagtttgggagttgaggaaactgagatcgtggcaaatcaacttttcccatttaaatccactatttcatcgctaatccagggttataacccaagactaactgctagtcaaagttgctttctaaaaatcagttacacagacttctaattctcgtgctgtacagtcagtgcagaaattgcaacagaactgttctttgttctgtagcaatgtgtattcaaaaggtaatcatttcttgtgtataaataacattcctccctaagagagatgttgtgggaatttatatcagtcaagaatgtatatcgataattaaacatagctagtctaaaaaacttgaagtgaaagattggttcgtattcaatcaactgaactgtttctttctctgcaatattgtggttcttgacatgattgctgagtttccaatttgacacttctggaggttcgtaaatcaggacacatgctgggtctcagtctgtcatcctgagtcttagcattggttatttatttccctttattacccaacatctatttactgcacaaattagtcgagaagctttccatgacggacctttgtgagaaaaaaaaaatgtgtacattgggtagctcttcaattacaaacatgcacagattgtctgggtttatgtgcatatactttattattatttcacttttgtatgtcagatgaatttggtgtaaatgtaaatctaacaatatgggctctagtggccaaatacattgccataatatgtttttgatctgtcagtctcctgggtgaagtgtcgcaagtgtggtaaaattctgtagtataaattgatgctcagttatggacaattaccaggtctatatgatgtcagactaccacactgatccacttttaggataacagcttcgctctgatgatcttcagattttagatttgctttcattccttgacaaaatgaaatacatttaaaacttctaaaattgtcttttgtatatatttctgcagggtctactcttgggactactataacaatcaattgtactgctttgtttcttttattaaatagcagaatagctgcttgattcgtctgtatgtgctgatgtgtgtctgtgaatctagtccagttcactgtccaataagaatttctgaaatgttctttgtcacatcaatgtacagtcaaaatcgtattgtgtttgtagcagaatgattgcatcttttattattcacagcagccaaaatgacacatatttcacacgtgacaccttttttaaaaaagatgaattgtccaaagttgtatgtagaatatatttcacaaatcaaattccctatttaataaatggtgctgggagaactggctagccatatgcagaagagtgaatttctataaatagaatgcaactgtgtaaatagcatccaaatcaagaaacataatataatatagccagaagctcaggatcccccttcatgtcttctccagtcatgaacatttcacaagggtgactactatccttacttcaaaagttttctattactttttcctgtttttgtgtattatatgaaggaatcgaacagtcatatctacttgtctgtggctgtatttttccccccaacaatatgtttgtgagattcatccatattattgtatgtagttgtggattgttcacttttcttactgaataatattctattgataccacagtgtatttacacatgttgatatagatgagaaattgagtagtttccaacatgaggaaattgctgtcaacaattctgcaatccatagccatgctatcaacagtctagtacatggtttttggtgaatatattaataactatgcatttctgttggatatacacctgggagtggaattacaactcaaataatattcattttaaaaattttatttcgtttttagtcgacaactatattatggggtacattgtgatgtttcaatccatatatatacattgtggaataatcaaatcaggctaatagcatatctatcacctcaaatacttctcatttttgtggtgagaatatttaaaatcctcctttttagctatttggaaatatacaatatgacaatattagctatagttcctgtgctgtgcaaaagaacaccagaacttattcctcctgtctaactggaactttgtacccattgataaacgtctctcatttttccatccacccaccactgcagcttttgatcaccaccataatactctccatttctatgagttcaactttttttaaactgcacatacaaatgagattatatgatatgtgtctctctgtgccaagtttatttcacttaacctaatgtcctccaggctcatccttattattccaaatgacagaatttcctaggtttttaaaattttttttttatttttaattttttggggtacatagtaggtatatatatttacggggtacatgaggtgttttgatataggcatgtaatgtgaaacaagcacatcatggagaatgaggcatccatcctgtcaagcatttatcctttgtgctacaaacaatgtaattgtacttttagttattttttaatgtacaattaaattattattgactatagtccccctgttgcactatcaaatactaggtcttactcattctttctaactattttttgtagccgctaacaatccccacctatcccctacctccacactaccctttgtagcctctggtaaccatccttttattctgtctccatgagttcaatagttttaatttttagatcccacaaataagtgagaacatgcagtgattttcgttctgtgactggcttatttcatttaatgtaatgacctccagttccatccaagatgttgcaaatgacaggatataattcttttttattgctaaatagtaccgcatcatttatatgagccacattttctgtatccattcgcatgttgatggacagttagcttgcttccaaatcttgcctgttgtgaacagtgctacaacaatgtgagagtgcagatagctcttcaatacactccctccttttcttttgagtatgtacccagaagtgggatttctggaacatatggtcattctctttttattattttgagaaacattcatactgtctttatggaggccgttactaattcacaatactaccaatagtggataaggtttccttattctctgtatcctcatgaacacttgttatctttcaactttttgataatagccaatccaaaagatatgaggtgatatctcattgtgattttaatttgcattttttgatgattagagatgttgagtattatacatatatgtgtgtgtatatatatatatatatatatatatatatatatgctgtttgtcatcttttgagaatgtctattcatatatttgcccatttttttattagggttatttgttttcttgttattgagtagcttgagttccttgtatattttggatattagcaccttatctaatgtatgatttgcaaatatcttctcccaatctgtgggttgtctctttattccattaattgtttcctttgctgtgcaaagctttttagtttgatgcaatcttacttacctatttttgtgttgattgtgtttgggggtcatatgcaagaaaccactgcccagaccaatgtcatggagctcttctcttatgtttttgtagtttttagtttcaggtattacatttaaggctttaatccattttgagttgattcttgtataaggggtgagataagggtccagttttattctgtatgtgaacattcagttttcccaataccatttattgaagagactgtcctctccctattgtgtgttcttgctacctttgtcaaaaatcaattgatcaaaggtgtgtaggtttattttagtcctctttgtcttattccattggtctgtttttatgtacttgccatgctgttttgattattatagctttgtaatacattttgaaatccagtagtgacatacttccaattttattctttttagtaaagacagctttggctatccagggtcttttgtggttccatgcaaattttaggattttttaaaaaaaattctataaagaacaatatgcagattttgttagtattgtgtcgaatctttagattgctttatgtttaacaatattaatttttccaatttatgaacacagaaatctttccatttatttgtgtcatcttcaatttctttcgtcagtgtcttatagtttcaacacgcagatctttcactttcttggttaaattcactccaaatattttttcatgctattataagtgagattgtttccttaatttctattttagacagtttgttgttattgtacaaacaataacaattgttatcgctactgatttttgtaagttgattttgtaccctgcaactttactaaacttgtgtatgaattctaacagttttcagtggagtccttaggatttgctgtataagattatgtcatcagcaagaaggggcaattttacttcatccttttcagtttggttgccttttatttctttctcctgcctaattgctctggctaggactcccagtactaagttaaacaagggtggggagagtgggcatctttgtcttgctcctgatcttagagaaaagccttctacgttttactgttgtgcatgatgttagctgtgggcttgtaatttatggcttttattcttttggagaacatttcttctatacctaatttgctaagagtttttctcataaaaggatgttgaattttgtcaaatgctctttctgagtttattaaaatgatcatacggtttttgtacttcattctgttatatgttgaatcacatttattaatttgcatatattgaaacaaccttctatcccagggataaatccctcttggtcatggtgaataatccttctaataaactattaaatatggttcactagtatttcattgagaatttttgcatctaatttcattcgtgatattggcctatagttttctttccttgtagtgtctttgcctggctttgggatcagggtattgctggccttgtaaaataaatttggacgaatcccttcctctttagttttccaaaagagtttgagaaagatttgtgttaggtcttctttaaatgtttgtagaattctcccatgaagccatctggtcttgagctttcctttgatgtgagaacttttaaatactgatgcaatctccttaactctttccttagctgttactggtcttttcagatttccaattttcattattcagttttggtagattatgtatttctaagaattcatccatttctgttaggatgtccaatttcttggtatataattgttcatcgtagtctcttaggatcctttgtatttctgtgttatcagtcataatgtcttctctttgatttctgatttgatttatttgagcctgctctcttcattcttagtctagctaaggatttgtcaattgtgtttagcttttcaaaaaaccaacttttagttttattgactttttttctattgtttctctagtctctatttcatttatttctgctctgatctttgttattttcttctttctgctaactttgggcttaattcattcttctttttgtagtttcctgaggtataatgttaggtatttcatttgagatatttcttcttttttgatgtaggaatttattgatataaacttccctcttagcactgcttttgctacccccagaagtttttctatgttgtgttttcatttctgtttgtctcaagacttttaaaaaatttcctcttgaatttcttcttttgacccaataattgtttaggagcatattgtttagtttccacatatttcttaattttatatgatttctcatgtaattgatttctaattttatattgtggtcagaaaagatacacgatgggttttcttaaatttgttgagacttgtctgtggcctaacatatgatctatcctggagaatgttacatgtgtacttgagaagaatctgtattttcctactgttcagggcacaatgttctgtatatgtctgttaggtccatttggtctaaaatgtcattcaagtccaatgttttcttatgaatttttctgtctattgcttaaagtggaatattgaaattgcctgctattattatgttataggctatgtttcccttcagatcccttaatgtttgctttatatatttaggtgctctgatttgggatgcttatatacttgttatgtcctcttgatgaaataacctttatcaatatataatgatgttctttgtcactttgaacagatttgacctaaagattattttgtctgaagtaagtgtaactaccctgctctctttttgttctcatgtacatggagtatcttttttcatccctttactttcagtctatgcatgtcctttaaggtgaaatgagccacttgtaggcagcacatatttgggtcttgttttttgttgttgtcgttaatccactcaaccactctatgccttttgattggagagtttaatctatttacattcaaaataatgatggatgggtaaggacttactagtgtcattttgttcattgtttcctggttgtcttacagattctttgttcctttcttcctctattgctgtcttcctttgtgttttgatggttttgtgtagtagtatactttgggtcttttgtttttatcattcatgtatgtattataagtttgtgctttgtggatactccgaggcttacataaaacattttataagctgataataacttaaatttgattgtgtgcatatactcaacactttgactctccctcctcccacattttatgtttctaacatcacaacttacttttttttttaattatactttaagttctagggtacatgtgcacaacttgcaggtttgttacatatctatacatgtgccgtgttggtatgctccacccattaacttgtcatttacattaggtatatctcccaatgctatccctcccccgtcccctcaccccacgacaggccccggtgtgtgatgttccccttcctgcgtccaggtgttctcattgttcaattcccacctatgagtgagaacatgcggtgtttggttttctgtccttgtgatagtttgctgagaaagatgatttccagcttcatccatgtccctacaaaggatgtgaactcatccttttttatggttgcatagtattccatggtgtatatgtgccacattttcttaatccagtctatcattgatggacatttggattggttccaggtctttgctattgtgaatagtgcagcaataaacatacctgtgcatgtatctttacagcagcaggatttataatcctttgggtatatacccagtaatgggatagctgggtcaaatggtatttctagttctagatccctgaggaatcgccacactgacttccacaatggttgaactagtttacagtctcactaacagtgtaaagtgttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatatccttcgcccactttttgatggggttgtttgttttttcttgtaagtttgtttgagttctttgtagattctggatattagccctttgtcagatgagtagattgcaaaaattttctcccattctgtaggctgcctgttcactctgatggtagtttcttttgctgtgcagaagctctttagtttcattagatcccatttgtccgttttggcttttgttgccattgcttttggtgttttagacatgaagtccttgcccatgcctacgtcctgaatggtattgcctaggttttcttctagggtttttatggttttaggtctaacattaagtcttcaatccatcttgaattaatttttgtatatggtataaggaagggatccagtttcagctctctacatatggctagccagttttcccagcaccatttattaaatagggaatcctttccccatttcttgtttttgtcaggtttgtcaaagatcagatggttgtagatgtgtggtattatttctgagagctctgttctgttccattggtgtatatctctgttttggtaccagtaccatgctgttttggttaccgtagccttgtagtatagtttgaagtcaggtagcgtgatgcctccagctttgttcttttggctcaggattgtcttggcaatgtgggctcttttttggttccatatgaactttaaagtagttttttccaattctgtgaagaaagtcattggtagcttgatggggatggcattgaatctataaatttccttgggcagtatggccattttcacgatattgattcttcctatccatgagcatggaatgttcttccatttgtttgtgtcctcttttatttccttgagcagtggtttgtagttctccttgaagaggtccttcacatcccttgtaagttgtatttgtaggtattttattctctttgaagcaattgtgaatgagagttcactcatgatttggctctctgtttgtctgttattggtgtataagaatgcttgtgatttttgcacattgattttatatcctgagactttgctgaagttgcttatcagcttaaggagattttgggctgagacgatggggttttctaaatatacaatcatgtcgtctgcaaacagggacaatttgacttcctcttttcctaattgaataccctttatttctttttcctgcctgatcgccctggccagaacttccaacactatgttgaataggagtggtgagagagggcatccctgtcttgtgccagttttcaaagggaatgcttccagttttgcccattcagtatgatattggctgtgggtttgtcataaatagctcttactattttgagatacgtcccatcaatacctaatttatcgagagtttttagcatgaagggctgttgaatttggtcaagggccttttctgcatctattgagataaccatgtggtttttgtcgttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcgatgttcatcagggatatttgtctaaaattctctttttttgttgtgtctctgccaggctttggtatcaggatgatgctggcctcataaaatgagttagggaggattccctctttttctattgattggaatagttttagaaggaatgataccagttcctctttgcacctctggtagaattcggctgtgaatccgtctggtcctggactttttttggtttgtaggctattaattattgcctcaatttcagagcctgttattggtctattcagggattcaacttcttcctggtttagtcttgggaaggtgtatgtgtgcaggaatttatccatttcttctagattttctagtttatttgcgtagaggtgtttatagtattctctgatggtagtttgtatttctgtggtgtcggtggtgatatcccctttatcattttttattgcatctatttgattcttctctcttttcttctttattagtcttactagcggtctatcaattctgttgatcttttcaaaaaactggctcctggattcattgatttttttgaagggttttttgtgtctggatcttgtaggtatgcttcattgtttcttattatttttttcttttgtcttctctggctgtgtattttcaaataggctgtctgcctacaagatccagaaaatagcctcaaaagggtcaatctaagagttattggccttaaacaggaggtagagaaagagatagggatagaaagttgatacaaagggacaatatcagagaacttcagaaacagagaaagataccaacattcaagtacgacaaagttatagaacaccaagcagaattatctcagagactacctcaaggcatgcaataatcaaactcccacaggtcaaggataaagaaagaatcctaaaagcagcaagagaaaggaaacaaataacatgcagtggagcttcaatacatctggcagcagatttttcggtggaaatcttaggccccgggcatatccagagatgctgtctgagggccagtcattggagtcaaaaaccttagcagtttacctcatgttctattctattgtggctaagctagcactcacaccacaatataaagtgctccctgctcttccttgcccttttaaaaggcagaggatcctctccctgtggccctcaccaccatgagggttctgcttggcctccactggtgttcacttaaagcccaagggctcttccatcagcttgtggtgaatgctgagagaactgggacccatattttagggccttgggctcccctctggcccaaggcaggaccaaaaatgctgtccaagaacctaggccaggactcagaaatcccagaagcctgcctgcttctctgcctttctgtggctgagctggtacctaaggggcaagacaaagtcccctttacttttctgtctacttttctcaaacagaaggggtctttcaccataaccaccacagctgggaatttgctgggtgacctatgaagccagcacatctcagaggccaagtcccacagtgtactccctgggtattgcaactggttattcaacgttcaaggcctctttagttagtagctgatgaatcctgataggactgagtccttccctttaaggtagcagattcccttttggcccagggtgtgtctagaaatgctatccaggaactagggcctggaatgggggcctcatgactctgcccatgccccatcctactgtggctgagctggtatccaagatgcaagacaaagtcttctttacttttcgctctcttctccttaacgagaagtaaggagtcacttctgttgctgcaagcttcactgctgggagtaggggaggtatggtgcaaccactcccttagccatgccagctggtgtctccctaggtcatgtgggagaccctaatccactggcttcaatatatagagggacgtttctaaattatttatctgtaatttgattaagaagatagacacaggcaataggatatgccaacagattctctctaacctatagttattttaagaaagttagggaaagagaggtcattgattagttttggcttactgaattatttgaccctcccatatcttttaatttatggattttatataaggcacagatattctactagtaaacatgacattaaagatgttttatacaaatgaatgtggttgatacaaaggcattaaataagaaacaaaggaaattcagaggacatttgttcgcctggaatagagatcattagcataagcataagaggaaaataaggaaggaaatgggaaagtcttgagtccattttcaaattatgaaaacttgaaatgcaacaaacaaatagtggttacttaagaagaaagactgaagatgctgggcaaaggttaactttagaaatggcatttttatatcattataaagagaaagtggggataatggaaataatctacatgtacaactcatttgacagacatttattgaaggtattccaaatgccaaacactagtttgtgcactaaggatgtttttaatttttactttttactttatttttattttctagcttcttccgctttgccagagaaggatttttttaaatggataaaatactaacttaggctagcttctttcagaaacagacctttaaacaatgattaatggtgaaagtggtttggttgtaatgtgatcccaggaagtaccagtaggagagtgggacaatgagataataaatgaaagaagccaataattaagccagttatggaactagttattgctttgggccactggggtttgatcctgatgaaggagctctgggagatagtaaacaaacaaacaaacaaaaaacatgcctcaaagttgtcaaccacaagggggtaaaggcaaggaaccagggctaactattccaactcttatccatcattggctaaatgcttcctggtacataaactttccagcacttctggccagcgcacctagcaagctgaggaaaatctctcaggtttgcagtagggcaaatgcttgtactaggacactgctggcatatacttgaaggatgagtgccaacggcagatagatgggccctgacagcatcttctacagattctgtccttgcctttgaggcaaggacactgtctagagtcagagacagaaatgtaaaatgtaaaaatgtaaatcatagtagcacacagtacaagttttaaaatcttaacaaagtgttatgggagaaccacggtgagagaaaatgactgcacatatgagagcaggggaagtctttatatgtgatgatgacatttgagtgggtgttccgttatcaaagatctacttaaaagggaaaaagagtagaattattttaaaccatggatgtaaccaggcgtggccaccctatatgtgaatgtcctgggataattttgtccccagatgtctctctttttgagtgtcattttcatttatgtattcataatataaagaaattgaatagaaagaggtaaacattggtggcaaaaatcccttcctacccataaggctcacagaataatgttgtctaaatgccataacatttttggtaagttttggttctatgggctttggaaattttttatgtaggaactcctccaaggtgatataagcattcagtgtatttatctagataccctagttaaagctactttaagcaggatcaaagtcctcttttaaacttttgtatttgaaagctattcccatgtacaattcccatgattcttgtacaattcctaggagacctttgtttacatcaaaagagtttgtctctctctataagttagaacttgtacattgtagtaatggaaaatccatttcaaagtagcttagacttactcagacaaaatgtattgatcagtgtcattaaacagttgaaagatagacgaggcttgattcaggaattaaatagcatgaccagattctagttttccttctccattgcatggctctgctccccagtatttgttccgtttaattcctcttaattgttctaagatggatatcaggatactgcagaactacgtgctttctcatccatcttaaacaagaagcaatgggttttctcttttagaatcacgaacaacaacaacaacaacaaaaatcctagagttgtttcattggttctgattgaccttacttggaaccataagtccatctttgaattaaccactaaagccagggagatgagttaaaactaagtacacaccatccacagagcaaagagaggtctattgtgggaaaactgcacaaatggaaaaataacaggggaaacacaggagaaggaggtagttagttaatgttcaatacacgcaccttctcagggacttttcttccatctggcatcatctttgtcttttgaccattttccccaatcaatacctatattcatactcaagttttccatatttgggaaaaaacttctcttgacaccaaactcccctctgacttccttcttataatgatctatggttggatagtctacaatttactgtccttactttttcataggtattttttaatctcctacagtaagatttctaccactgcactgaaatcattttgtgtatggtcttcagggaattccatgtggccaaagccaatggatacttttggcatgggctttggaggtctaacttcttgaatccaagtgtcggctctaacaatcactatctatgtgaccttagaccagttatttaacgctgtctttatttcctcatttgttaaatgaggataattgcagcaatagaaaaagaacgtaaacaattatacttataggattgtatgatgattaagtgattaatgcaaggaaagaacaacacagagcttcagacagtgtagatattcaaataaatgttagttatgatttttattatgtcttgtgacatctatgagatttgaaagtgttaatcactcttgtgtttttgaaaatctttcttttccatgttctataaaagtacactttcttgatattcctcctccttctctagtctttcattcatcttatttgctctttgtgttttatttattctttttacgttgtattttccaggagtccattcccagcccggtgttgggctcagtctatgtgccatataaatgagaatgcacttgcatttgaggctttgctttttatttctctgtagtgacggccaatcccagatttctgtctctcccaaaatacacagctatgctatagatccttcagtcctcctgactaaaatgttagttttatgtgtgtgttcctcacaacctcccagtgaataggtccaaaactgaactcattatcttctccatgctcactctgcattctttggataggcagtgaatagcaccactatctaacaggcacctaaaccagaagccaggtaatctgtcttaaacccttttgttttccaagttcttatcataatggctggtgtctaacagatggtaaataaaatagagactagctggctacatggatggatgtgtggggatgcacagagggatagatggattattgagtgagtctctagcctataaatatttttaattaactaataaattatgataatgtacagttgaaggtcaagggtgaaaaagcataccctcagtgggatgcacaccccaaggagccattttaacttgctacataacacacatatgaccacttttttgctgaaagccttctattattgagcaagcattcaaatcccatgtttgcctgaaataatggttcaggttataaaagtttccttctttttccaggattaaaattatcttcctacataataggaagaactgctttatcttttcctaatatctagagatggccttttaaaaatatagactgttttccctattgaaatgaactgtaggatgtacaaaatatttactggcatgaatcaaaagagcttgctatgtttatgtgaaaaccactaggcattctaaaaaatattgctagcatagtaaaatgttagtaattaagactaacgaaagcgaaggcaaattggaatcagagactatttttaaggaatgtcaactgtattattttcaaatacacatggtacataacagtaggatatgagaaaaagtcccaagtatgtgtactaaagtagcctgctatgataagttgaaaaagggtttgtaattggaatatccacagaatatttcagaacacttaaagacattttcatttacactttatacagctttcttataagagcatttacaccatttattttataaaccaaagattaattagaagactaaacaattacaaggcctcaactacgaaagctgttccactacctagtggaacaacaacaatgagacacacaaaacaatggcgttcaaagattagagagagacttacggttaaacagaggttgacatgttaactgaagttgcaatataatatgtcgactagttttgcaatacatagcaaacacccaaacagaaataaacctgataaaaaaacagtagtctataatgtgtgccacttactgagttttaattattctggggactatatttttgatttcatgttacaatcactagttttgtggggtctttctagtcctgatgcttatttacaaaatatctgaagtatttctttctatgtatttatttttgagatggagttttgctctgtcacccaggctggagtgcagcggcatgatctcggctcactgcaacctctgcctcccgggttcaagtgattctcctgcctcagcctcctgagtagctgggattacaggcgtgtgctaatttttgtatttttagtagagactgggtttcagcatgtcggtcaggctggtctcgaactcctgacctcatgatccacccgctttggcctcccagagacctgggattacaggcgtgagccaccgcacctggccatctcaagtatttctttaacttataacttcacataactttgtggaggcaacagggttaattaaaaaggactttacttacataacaaaataagaagcatagttttatattcctgtgccatatacattttgtttgtccatctgtagccattctttgaccttctctcccttgctctttattctgggaggctgacctctgtcatcattgggctcccatgccctttggcttccagttggtttaggcacccaagagccctagaaggaaattgaagacaggaggtaaagtgaggtcaagatatttattctcctaattccctccctttgaggttgccacaggctgactatgtcctttgacaaaaggttattgctcttctcagggtggtttctcattccaattctctgcttttggccacttttccctcccctcatcccttgggcctagatgtagtaacagctctactgttgcaaggttcttgtattatctgtgatggtttcttataccctgcttatcttgtgatttgttgctttgtagataaacctctcagattatctaggcaagatcatagaagaacacgtatgtccagctaagatattccagaagacagtagggaaacattgaagggttttataagagggagtgcagtgatcagatttatgttagttttaatctttaattggggtagaatttacattctaaaacagagatttgggtctgggaggatgatatagagcctcttatggatgtgagggcaaaaaatgatagaggtttgcagtgccaatagaaagaggaaagaagttatatatgagagaaatttgtaactaattatatgaggtgttgggtgacgcttaggaaagaatctagaatgtctatcaggtttcatgcttaagggataaagtagatggcagttttattacttgttttctgtattatttttatttcataaaaccagcttagagaagttgcatagaaaaaataatgtagtcctgtttattttaatatttgaaaagaacatatttcagagtagaatctatatagtacctccctcttggacttccaatgataccagtgatagcctcaatataagccagtcttacaaaatgcacccagcgtgaattcttaggtattgttaaaagaagttggccaggcgcggtggctcacgcctgtaatcccagcactttgggaggccgaggcaggtggatcacctgaggtcaggagtttgagaccagcccggccaacatggtgaaaccctgtctctattaaaaatacaaaaaaaaaaaattagctgggcatgatggcacgtgcctgtagttcctgctactcgggaggctgagacaggaggatagcttgaacccgggaggcggaggttgcagtgagcggagattgcaccattgcactccagcctgggttacaagagcaaaactccatcaaaaaaaaaaaagaaagaaaaagaagaagtttctaatacacttatcttcccttgggttcactcagaagacccttggaaaaggttttaagagcaagtgatttatttggggggtaaattaatcagtagaagagtggaaaaatgagacaggtgaggcaaggcagccagtaaagagtggtgcattatcaagccagctgctgttgtgggtcactggagctttatcccttgggaaactctggaacccttgtaaaatacatgcctcagagttatttcccctagcatcaagggagctagtgtaacaatatcccaattcctacaattagtcattatatacaggctgcctctgggagctggaggggaggcatcagttgcctggtatgtctagcctgtcacatggatggcaaagcaaactcctgtggcaacagaaagccttcaggcaatgaaatgctggcactgggaaatcaggctgatgggtgctgaagtggcaaggatgaggggatatggatattctgctgtagtgcttttctaacagatgattcatatttggttctagggatcaagaattgagttaaaattttatatatatgttgatgttctatgtcaccttcaggaaaataatttaacagaaactaatatttgccatcaaaaaagcaaagaatcctgttgttcatcatcctagccataacacaatgaataattttttaaataagcaacataaatgtgagataacgtttggaagttacatttaaaatgtctcctccagactagcatttactactatatatttatttttccttttattctagttgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaaggttagtatcaaagatacctttttaaaataaaatactggttacatttgataaaattataccatagattgtaatttaatgatgtttaatgtaaagttattaacagaaaatcacgttaaagctgaaatgaacagtagactttgtatatttattttcttagagacagagtctcactgtcacccaggctaaagtgcagtggcacaatcatagctcactgagccttgaactctggggctcaagcagtcctcctgcctcagcctccctagtagctgggactactagccaggcgtgtaccaccacgcctggctaattttttaaaaatttttgttttctgtagagatgggttcttgaactcttggcctcaagcaattctccttccttggcctcccaaagcactaggattacaggcatgagttagcatgcctagccagtagacttttgagtcaaggtagagaatagaggaaaattgacagctaatgtcaatgttaaagttaattttgtttagtaatctggatatagttggctggttttctgttgcaccatctttaagatcacttcaaaattggtatacgtatttatgtagttgcatgaagtcaaccattcgggcttaattccttcctagaaaaagtaacaggtctactctttcatatcttatttggaggccctggatcaagaaatgggggtgagtgggtatcaggattggggaggaataaggagtactctcactttctccccccattctcttacctccagcccagctcattcttctcttctttctctttcctctgaaatttcctcaaatatctgtctgcttagtagtctataattcctcaggataaaagaaaaaggaaaaggaagaaaattgcttaataactatgttttatcaagcagcatgcatagtgctttgcatgcgtttaatcccttcaaacttagtatttactagtcagtttgaaaagcccttaaatgttaaacaatggttaagctttagggtattttgagcagggaagtaacatggtaggaggttgatcagattgggcacttgatcaaaaccctctatagatattttatctgacagaaaaggccttttgctaaaccagtatctgattctcaaattggttatgtcatctaagaaggaaaccgtatcattttcttggatgaaatggcttccatttccaaattagtcaggttaggctatgctaagctatagtaagaaatgaactctgaaatctcaatagcttaacacaataaagactgctttcttggttatatcatagtccagtagaggttgacaagccattcttaggagctgtcccccaacatggtcacttggaaacccagacttttccaattttgtgacacttgtcattttcaacacactgccaaaagccactgcagaaaaggaagacagaatgtggtcagtcaatccatggtgttttatggccaggcctggaaattatgtatatcacttccaccacatcccatcacacagaacttgttctcgattgaatttcaggaagagttaatggaattagtgagcttttagccaatctctgtcatagccattttatcgaagggacctgagctgctatgaggacaaggttttagtttatatgatgaggatgttagaaagccacatagaattttacagtcttatcattagctctgttggagtcaaaatctaggtgaataaaaattctttcaagagacacatgttaccactaatggttttttcaatggatgagcatagatgaattaggaatctccaatggtcattttcctaattcctggtctgactatgtaatatatagaatcatgtggttattcttgaaagctctagtcatattcgtgaggtagtcagcatgttatgctacttctttttcttctctataagtttcggatactatgaatctattggatcacaaaccaaagtagttaactggtaagaaggtataagcagaaaatacgaagtttggactggatccttgagttagatgagaagaaggagagatgagaggcatacagtgatagatttgactagggcaagaggactctggtagttagcaaatgagaaataaatttaacctaagaaaatcctaaagtgatggtaagaatggttagggtttaattgctcttagaagagcaagtagctttaaataagagacaaaaatatctgcagaaggaaatatgaaagtagaaaacaaaacaattgcattgtcaaaacatgtaagatgttttaatcacctaaaataaaaccagaattgtattataattgctatcctttgtcaaacttttgaaattaaaaaaaaaaaacgctttggaatggtctaaaactacatcataaaaatggctcagccactatctatagagattgacattttttgtttgtgctctgtgtttaggaatttaatgatgtgtattgctgcagattcaatgtaagttcccgatacagataaagatggccaaagctgtaattttttcatccatttcttgaatgatgtatgctaaaattaaagtaatcctaatgttaataataacttttagtgaatgcttgctgtgtgtcaaaaagtatgctagtcactttatatatattggtttatttcatcctttcaaaaacactctttgaaaagtactcttattattcttagtttgcagagaagaaaactgaaggctagagaagttcagaatcttcttttgaaagtagtagagttgtgatgcgaatgcatagcaattactcttgtagatgacctcacaggcttcctcttccaattgtctacgtggctaaaacaaagcaagaaaaccccataagaatctgaaaaagactcatgtaattattaattgacaaataagattatattacattactgataaaccaacaggtagaaaatgaaagcaatgaaatagtatactgcgaaaaaaaatttcatattatattctttgatgaaaaaataaaacaataattgcaaactgcatttcatttttaatgaaacgacaatgtttaattcttctaaaaggtagggagcaaataaaatggttatctggtctttacatcgaatgtgtcatcactactaagtgatattagctggcttattacttaaaattttcttttaggaaaaaagtgtgaaaatagacaggaggagacattaaatggctaaagcaacacccccttgctccgtaagttctttctgagtctgtgtgcctaagattaacaagagagcctgtgagcctcacaaggcaatcacaaagctatgtctacagccttggagagctgtgattacagcagccagcctcctttgcagcacctcagtgatgactacactaactctcactactgagcaacaatgaaatgtttcaaacccaaccaccaacactgttataactcttaaaatttgagccagtcaccatacctgaacgtaaaaagaaaattaccaaaaatgcttgataccaaaaagcaattaatgattcataattgctaatctttattgacagtctcttctagttcttatctacatatattttaattgtctacataatgtaaattaaattttaaattctgatttgtaaacttaatattgcataaatatttatcaatgttgttaaacatcttttaataattattttaacttctttatattatttcattaatttccatctttatgtccttgctggtctgacatttagaaaaaactcctccttttatttagaaaaaaagaatggtgaggccgggcgcggtggctcatacctgtaatcccagcactttgggaggccgaggcaggcagatcacgagatcaggagtttgagaccggcctgaccaacatggtgaaaccctgtctctactaaaaatacaaaaactagcctggcgtggtgctgcatgcctgtagtcccagctacttgggaggctgaggcaggggaatcgcttgaacccgggaggcggaggttgcagtgagccaagatcacgccactgcactccagcctgggtgacagagcaagactctgtctcaaaaatacataaataaggagaataaatggggacaataacaacctattcacagaacagaaataaaaccggagatgtcatgtggaaaaagcttatcttgaaagcgtggtcagagtggaaagaaacagcaacaggagagtcttgatttggtgaaaaaacagaatgcagatggcatagagtatcaacaattaattagcaggccatcaagagacggccataacatattggtaattgttttctttcacccttaattttttctaaaacaaaaacatgaagttagaaagtagttaattttgttagccacatggcttcatggtttaattttatcttctctatgggcctggtacaacaataaagttcttttgagatagaaagacagatgttaggcaaaaacatacaagattttcattctaatcaaaatctttgccaataggctatgacagaatcctatgagagatgatgccatttagaactttcacaagaggcaaaaatagtatgccattggcacctaaaactgccaacagtgatcatcataggatttatttcatttggcggattcttggttgagttcataacctgttccctaggcttttaagattggtccaaacttggcaatggattctttggaaaaattatttcttgatcgttttaaactttcttttccagtgtcaagagagattttcccaggctccgagttttcatttattttttcccctgtcagtttttgaaagagaaatcccctttttgtcggctttgtgattgcttttgtgtcaaattcagcgtaaaagcttttcaaacgtgacagcattagctgttttgtgcttggctgagctaagagtacatgaattcaatagagaagtgaaatcttgtttgagcctggctgatttggctatataatattgaaaactatctgaagcaagaaattcaatacttttcaaattattgaataaacatttctaaggctgcaaaatctctgtgtttttgaaggcattctttaggaaacttgaaacacagacattctataatcacataattaattttaaaagttgaacttattgtatgtagtaactaaggcagctatttgagtgtctcaaattattttactaaaaagggagacatttttcaaatatggaagtagtgccttacatttttagttatctgtggaaggatcgatggcatcatatatctcatccaccataaaaatatgtacggtagtggaaactgaatttttcttttatatattttgtgtattttttggagttgtacaaaattaaatcagcaaattgacccacactagtagtttgaggtttgggtttctggtacaataatgaaaagcattattagaaatcttcttgccaggacctaccatttcttcatgtattttctttattcccttttgttctcccctaaagcttctatgtgattaaagagaaaagatcaataacccaatagtacttttccttctaaagtatgcatgaaactcttaaagttctcaaagcatacaaacagagtgctctctacattgctgatagaacacaggtagtaatgggctagtttccccaggtaactattatattatataaatatttaatgcagagtcaccaagccttgaataactttatgctttgattgtaccatattttctctagtttgcttttcacaatttaacttatcccgtgcttgaaaatataatgtggtaactgtgtaaatctgctcctcaaaaaattttcgaaatcatcttttcttttttcttttctttctttttttcctttttttgagatggagtctcactctgtcacccaggctggagtgcagtggcatgatcttggcttagtgcaacctccacctcctgtgatcaagtgagtctctcagcatcccaagtagatggaactacaggcacattccaccacgcccaactatttctcgtgtttttagtagagacagggtttcactatgttggccaggctggtctcaaactcctgacctcgagtgttccgcccacttcagcctcccaaagtgctgggatacaggcgtgagccaacatgcctggccccacatcgccttttctgaaccctgggaattaaccaaaggctggcaacaatttttgaaatgctgactctcaataaaaatggcaaagtttgaggttttttaagttggcctttcccgtcactttctcccagctccacagtagccttgaaaatcagtagccttgcaaccataatagctgtgaaaactagcagccttttagccaccagagagtgtagaccaggattggaattcttcaaaaaggccaattttattccaagaaccttgccactgtttgacctatcttgcagctccctggaataaacctatatacatggccttgcctttatttggcccgacttagagataactttctaggaaaagccctagctccagggtgttggtccaaaccaattagcagcaattctttaacataacaggttcctaaggctgtgatgctagttgagataaacataggtctggagaaaaacttccagtgaagctctggagaatgaggtgtccataggggattttggcaacctctgacatgttcttgcgggatctagaagcccatgtgcttgtcttaacaaatagagagtatcaataaagagatagaaattgtaaataagaactcagtggaatatctggagttggaaagcacaataactaaaattaaattttcacttgacgtcagattcaagctgcaaaagaaagaatcagcaaacttgaaaataggtaaatgggataatccaatccaaagaaaagaaagaaaaaatattaaggaaatacagaaagcaaaaactgactgaactgaaagaagaattaggtaattcaacaaaaatagttggagacttcaacatctcacttttaataacaggtaaaagaactaggcaaattaacaaggaaatagacacttgaaaaagactataaagactataaacttacaagacctaacagatatctatacagcgtttcatccaataatagcagaatactcattcttttcaactgtacacgaaatattctctagggtaggccatatgctaggtcataaaataagtctcactacattcaaagggattaaaatcatacaatgcagattttatgaccataatggagtacaattaaaaatcagtaacagatgtaaatttgggagttcataaatatgagaaaattatacaacacactcttaaatagccaatgggacaaagaagaaataagaaaatacaaaaatatcttgagataaatggaaataaaaatacaatataccaaaacttatgggaggaggctgaagcagtgcttagagtaaaatgtataactataaatacctatatttaaaaaggaaaaagatctgaaatcagtagcctaagcttctaccttaagaaactagaaaaagaagagaaaagtaaatctacagtaagcagcaggaagtaataacaattagtgtgaaaaaaatcagatagaggaagaaaatataatagaaaaaatcaacaaaaccaaaatctagaaatttagttatttgaaaaggtcaacaaaattgacaaagttttagctgattggttaggaaagaaatggtcaaattactaatattagagaaaaagagggtgcattactaccaacattacagaaataaaaagaagtaaaagaggatattatgaacaactaaacaaatagataacctggatagacctataacaagaaattgaattggtattaaaaacttctcccaatgaaaggctcaggcccagaagtcttcccccgatgaattctaccaaacatataaacaactcttccaaaaaatagaagagaaaggaacacttcctaaccagacaaagatatcacaagaaaacaagctacagagcaatatgccttatgaatatagacttgaaacgcctcaaaaaattatcaaacctaatacaacaacatattaacatgattgctaccataaccaggtaagatttatcacaggaatgtaaggttggtttaacatccaaaatttaatcaatgtattataccatatcaatagaataaaggacaaaaatcgtatggtcatcacaataaatatagaaaattcatgtgacaaagtacaaaaccctttcaagcttgaaaaataaagaacacttaacaaatgaagaatagaaggtattggccaggtgtggtggctcacgcctgtaatcccagcactttgggaggccgaggcagttggatcacgaggtcaggagattgagaccatcctggctaacacggtaaaaccccgtctctgctaaaaatacaaaaaattagctgggcacggtggcgggcgcctgtagtcccagctactcaggaggctgaggcaggagaatggcgcgaaccctggaggcagagtttgcagtgagccgagacagcagcactgcagtccggcctgggcgaaagagcgagactccgtctaaaaaaaaaaaaaaaaagaaggttttgtggattgaatagtgtcccccgctcccaaaagacatactaaaagcctgagcccaggtatctgcaaatgtgaccttatgtagaaatagagtctttgcagatgcagtcaagttaagatggtatttttataagaagaggaaaagaggcatacacagagagaagaatgccacataaaggcactgaccacgggaaaaacaccatgtgatgttacagttagagattaaagtgctacagttgcaagacaagtaaaactaatgattaacggccatcattagaagcaaggaagaggcaaggaaaaattctcccctacaggtttcagcaggagtatgggcctgctggaatcttgattttggatctagcctccagaagtctgagacaatgagttttgtctacccagctacgcaaattgtgacacttaattacagaagcccgaggaaacgaatacagaagaggatttcctcaacctgataaaaggcagctacaaaaattccacagctaatgttattgtgaaacactgaatgctttcccctaagatcaggaaatagtgaaggatgcctggtctcaccacttctattcagtattgtactggaagttcaggccagggaaattaggcaagaaaaataaataaaagacatccagattagaaaggaataagtaaaattatctctacttgcagacaacatgaccttgtaattagaaaattttgaagaatctatgaaaaaatattagaaataataaaataattcagcaaatttgtaggatacaagatcaatatacaaaatgaattattttatacattaaaaatgaataatctaaaagtgaaattaagaaaatatttacaatggcatcaaaaaatgttaaaaacttaggaataaaagagatgcaaggcttgtatactgaagaatacaaagcagtgttgaaagaaattaaagataaaaaaatagaaaaatatcacatgttctcagatcaaaagacttaatattattaagatatcaatatccccccaattgatctacagactctatggaatcattatcaaaatcacaactggcttttttttttttttcagaaattgacaagtggatcctaccatttctattgaaatgcaagggatgtagaatagtcaaaacaaccttgaaaaaagaacaacattggaggagttaactttccaatttcaaaaactactacaaagctacaattattaagtcaatgtggtactagaatgtgaatagacatatagatcaatgaaatagaattgaaagttcaaaagtaaacctttgcatttatggtcaactgatttttgacaagggtaccaagagaattcaatggaaaaagaatagtctttcacaacctggtgctagaataactggatatacacatgaaaaataatgaaatttggccccacctcacaccatacacaaaaattagcttaaatgtatcataaaagaaaacaaataatctgattaaaatgggcaaaacacttaaacatttctcaaaagaagatgtacaaatagctaacgggtttgtgaaaaatgctcaacatcactaatcattggggaaatgcatattacaatcgcagtgagatgtcaccttacacctgttagaatggctgttataaaaagagaagaatgataacaagtgttgatcaaggatatggaaaaaaggtaacacttgtatatcattggtgggaatgtatattagtacaaccattatggagaacagtatggtagctcctcaaaaaactgaaaacagaattaccataggatccagcaatcccacttccgggtatatatccaaaagaatttaaaccagtatgtcaaagagatatcttcactcctgtgtttattgcagcattagtcacaaaagccatgatatggaatcaacctaagtttccatcagtggatgaatggataaagaaaatgtggtacatatacacaatggagtattattcagccttaaataaagaatatccttttgtttatgacagcgtggatgaacctggaggacattatactaaatgaaataagccaggcacagaaagtcaaatactgcgtgatctcacttatgtgtggaatctaaaaaagtcaaactcattgaagtagagagtagaatggtggttaccagaggctgtggatttaggggtggaaaatggggagatgttgatcaaaaggggttaaaaactttagtcaggaggaataagtttttgagactttatgacacaacctggtgaccatagttaataatattatattgtatatttcaaaattgctaaaataacagattttaaatgttcttgctataaaatatgataaatatatgcagtgatagatacgttaaattgctcgatataatcattccacagtgtatacatatatcagaacatacatgtaccccataaatgtatataattatttgtcaaagcaaaataaaattaaaaataaaatgttttaaaacttttgtaaaataaactttataataataatatatttttaatgaatcatagagctaaatatattaataagaactaaaactttaaaactcttctaagaaaatgtaggaatacaatggattatgcagtgttttcttagatatgacaccaaaagcaaaagtaaccgaaaaatacacaatttggactttaacaaaattaaaacttttgtactgcaagcaatattgtaaagaaagggaaaagacaatcctcagaatgggtaaaaatatttgtaaatcatatatttgataagatacttgtatcaagaatatataaaaactcataattcaacaacaaaaaggataaatgacttaattacaagtgaagaaacagtttgaataggcatttctccaaagtagatgtatagatctccataagcacatgaaaagatggttaacatcattgattgtttaaaaaatgcaaatgaaaaccacaaggagatagtactttttacccactaggatggctaatacaaaaaatacagacaataacaagtgttgagaagatgaagaatgcttggaattttcacattactggtggaaatgtaaaatggtgaaacaactttgaaaacagtttggaagttcctggaaatatttttttaatttttaatttttgtgggtacacagtaggtatatatatttatgggatacaggaaatattttgatataggcatacaatgtgtaacagtcacattggggtacctggcctatccctcacctcaagcaattatcttttctgttacaaacgacaatctaataataatcagttatttttaaattcacaataaattttttgactgtagtcatcctcttgtgctatcaaatactagatcttattcattctatcaaactatatttttgtattataaatttcactacccattagccatccccccctttccccctaccactacccttcccagtctcctggaaatattaaacatgaagctaccatatgacaaaaccattctactcccaggtgtatgctgaacagaaataaaaatacatatgtacacagaaaacctttatacagatgttcatagcagcattatttataatagccaaaaagtagaaccaacccaaatgtccatcagctaatgaataaattttaaaatgtcctctacatccaaaaatggaatattatttagcaataaaaagaaatgaaatactgatatgcactgtaacatgagtgaacctcaaaaatatgctaagtgatggaatccagtcacaaaagaccccaaattgtatcaatacattcatataaaacatccagtaaagactgaaggaggaggagaatagacaatagaaagggactgttaattggtatgggtttcattgggggcaaataaaatgttctcaaattagatcataataatggttgcacaaccctgaatacattaagaaccagaaaattatgcactttaagtgggagaattttatggtatgttaaaaagtatatctgcatgtcattgactacagatcttttcttattttttcaagttttatgaacacagttttagaaacatagtctccatttttctctttcatgaagctgcttgccagctatagaaatgaaaaaatagccatgtctgtggaacataactgctacctagatgggagcctccatcacacaatggatagggagctattttcttttatggtcaagataggcaggttctgtcctatagaatatattctgagatgttacctgtagttcagaaaaacagggatattgttgttctaaacatttcctcaacatttatgtggcttcctatttattaataagagaacctgttctttatgtgtcattatactagtttattctagccctggtcctggtccaggactgtctggaggtattagaattgccctactctatgtgaaataaggtcatatctgaataggtatgtcagtcagcataggctaagctacagtaataagcaacctcaaatctagaggcttaatagtctatattttactcatgttacatgttcgttgtagactgatgagagcattctacttagcttagtcactcggggaccatggctgatggtatctccatcttggtacattctttcatgatcatagaggcaaggaacatggttcttgagccttctgcctggaagtgaccagtagacaaaaccagtcacatggccattcctgagttcaatgggaatgccgatgtataatcttctggcgtgaaaaggcactggatatttgagaacaataatgcagtctaccacaatatgctcatggggtctgaaaaggagctgaaaaaacgccattttctggggttctgtcctctggcattgtttctggaatcgtttccacccatccatttctacaccctctcaactgacttttctcagatgcctggggtagctgggtgatttgttaattacagtattgcttaagccttttaataaagtcagcaaattaaagagagagcccagataaagagaatgctttcaaaaatgtcataatgaaattaaggtaacgaagcacttggagacctctcctcccttctttttgtatgaaacttattccaaagcagctggaagagaaatggggcctgaaagtaaagaggggaaaaatatattgtatgccattagtttaattataaaaattcattacatgaagccatgtaagacagaaaataatggaactctaatgggttggccgataacacatttactagtctgctctcagcttgtagtcattgttgaaaggacagaaaagtaacgacgttggtatgtagtcttcaaagctattgtaaagattaatcattttcagtaagccggaaaatgagggccattttcttaaatagtatgccctgtatagagtgttaccttctgaaacagagttgtttggtaatgtcagaggtttaatagatgagtcttgaagttaatggtgagaggctttacttttgaaatggctttcttacagctattttaacatttctattataaatccataaagaggttttataggtcgttttaattcacacaaggagggaagaaattgtgcttctcttttcccaataaggatttatagaacattaattcattcttgggaccaaattgtttagtgattttcaaaaataaactatgtatttttctgctgtctttttttcagaaatgccttactttattatacataataattttccagtcatgctataatcatcaagattgttttatattcttcaaagctcagttaaaataaacccagtccttttccttaaatttctttatatggatgcataacttctttaactgaattgaaatgaaacctgaattgagagtccagaaacctgcatttttatgatgactctttcactgactagctatgtcaccttgaacaagtcacttaacctttcagagcatttatattctcatgtggacaattatggaattgctcaaaaaggaagaagatatcaaaagatgaaagtgaatatgtaggtaggggtcatatattcgagggccttgtaatccaaagagagaggttaggactttgtcttgcaggtaatagcaaaccattgaaaggttttacacagaggagaaatgaggttctatttgcattacaaaaagatcatttacgcagttgtatgtaggtggaagggtggtttgagagtggagggagggagccaataaaaaagattattttagtacctgagcaagagatgatagggacgtaaattaaggtagtgtcaatggaagtagaagatttggataaaagttaaaaaaaaaaaaaaaaaaacttatgatacaactacccagggagtatgttccctgcctcctgctccagttgaggaccaacatatcagattgatccagagacagaattttggagaacattaatatttaaaggacaggcaaaaaaaaaaaaaaaaaagcttgaacactcagagaatacagaggcgaccaaaagagtggaagccaagaaagcagagaacttcgagaagagaatagtcagcagcaccagttgctgcaaataaatcaagtaaataagaacttaaatctttccataggcattggcttttggtaactgaatcagttaactattttcacaaatgtgagtggcatatagcaataagcccatattgcctttcatgaattttcagcttgggtggggtggcacttcttcatgttgcaggttgattggggtcgctctgctccatatgtcactcattctcctcctgagatgagtaggctagtccagagcatgtttgtcttaaggtaatggtgaagtgcaaaagggatagccacactgcataaatacatttcaagcctctgcttgtgttacttctagtaatatcccactgggattaggcaaagcaaggcgcatgaccaagctcaatgtcaagggcatgctgtctttcgtaggaagaatttcagagttacttagcaaagggcatggatacagggagaggtaaagaattggggccagtaattcaatttgccatagtgacttctgtcagaatagttttagtggaacgatgatggcagaagcctgattttcatgaattggagagtggcacgaatgtagtcaagttgagataatgagtgaatatctgccttctaaagagtgtgactgtgaaaggaaagaaaatgatagagtgcagattattgttgttgttgttgtttaaagatgagagagacactcatgtttgaagtctctagagaaggtccccgcagagaggcaagaagttggaacacacaaagagagagggagtatgtggaggaggatcccagaatagatgggtgcccagatggtgaaatcaacttccaatagcagaaaagtcgcctcttcctctgagactagagagaaggatgcaagatgtaaagtctgatatttcatgaaatgtatgtttgatatattaaatttccccctgtggaattgtaggtaggatcatttactgtgagatttctttcagttcgtgttgtcaggaattagtctgtaaaccacattcgatatttcaaacagaggaaattcaatacagaggactggctcctccataggaatgaaggagctgacaaacccaacagaggacagtgaggcaacccagagtttagcaacttcaggaaactattaccacctcaagggctggggaaccgacaagttttaccaaagcccagaaaccagaaccatcgggtgctaattcacccaatgtaaggtctgcacagcaggtaatggaattacagagggagcagccgtccagtgggaaacggagacaaaggagatactgccaagacagagagagaagggggataattatcttgtttcaccctttctcatgctcttctgtctcccactagtgtgtctcatgacttaacctagttagaagccagctagcaagaaatcccaggaaattctgacctcctatgggagttagtacatctcaatactgagtggagtaggaaatgggtagagaatggatctaagagcaaacgacctcttggtggttagctaacagagttaaatttttccatgaatcccttggttcatgaatgtaaatacaggatccaaggaaaaataacaaatccaacatgtagaactttttgttcataagcatattaggatcctgttttacaattttccgagcaattgcttgattttgacacttcaggacaagccggaggcatggtcagagcaagtaaccccatcctagtttacagatgacaaaactgggacttacaaggttaatgacttccttaagatcaaactgcagaacaatggacaagcaaaacttcctgggaagatgtcctttcgttactctgcactgcctttcttgaagttcctttgagacacagtcattaaaaatttaagtaatagttcacccggaacaaacatttattttacttgtaggtgaatatcacaaaacacattttaaaaggaaatttaaccaatattcaaccttaaaattttaatgatagagctatgcacttgcttttatcttccaagttaaagggagaattttagagttgcagcatttctagacaatgtccataaaacagcgagctacttgctttgcattcagaaggggctcacactgtggggaatatagtttgactcattaaaattagtagtagatgtgctagcagtagtaatgatgatgatgatgctgatgctgatgatgattaatatttatttaatccttcgggcacgccaggcacctttgtaaatgttctccctgaattctctaagttaacccacctaatcatatttccacataaatactgttaatattcccatttagcaaaggaggaaactgaggcacagaaaagataattaactctcccatttgccactaagcgatcacgccaggattcaaacccagcaggctcattgtattgctcaggcttttagctactctttctcttcctcctctcttttctaccatgtagggtcaatatcactaaaataagttcttacacataaaagaaatgagagaagacaaacaattaaagtagaaaaaaatactcaaaattcttgaaattaattcaggttgtctcatagtccacaatcactttttctacctaagatactgtgaatatatatcaagcacatagtgcagtagcagcataatgggtttgaatgtgaaacatttctttcctggttggggaaacaatcttttggggatttagcattttatattcttcatagaaaacacacacacatacacacacacacacatacacacacacacatatacaaaggcaatctttttttataagctagtgctcacagtattttaaatttcttcacacaccatgatcaccacacaagcaattccctgtggtgtacaccattgtcaatggaattcagaaagagaaaagggtgtgtgtgaagtctgttgtatttttgaatttacactccttctgaggtctggagttatcccagtagtaaatttcacagcagtaggcaaagctggtcaaggtcatggttcctagtgtgaatgacacttgggtaaaacccaaggtgggcgggcagaatattaccgtaggagaaagggaaaacattctgtgtggggaatgtctttaagaagggagaaaaaaaaaaaaggctacctttgagaacctttgtgtttatataagggcctgagccccctcaatgtcagtcaaggtcagtgggagttttactttttaatcctacatcctcacaaaacctgggcagtattcagtgagggttagcactcagtcaagatttccttaggtataacagtcctaactttcgctgtgaatacaattttgcagaaaaatatatggcacgcgtatttctacctttcaagcattaaagtacatcaaaaagttctggtttgacgtcaagcctcactctttactaccttgtttagtaggaaatctgtcatttaactctagcttactatttctttcagagattttggaaaattctaggatatgttataatttataattttaggcatttttatgatctattgattatgtttttagattcattggcaccttctgcattttatgttttttaattttaacagctttattgaagtgtaattgatatacaaaaactgcataaaattatatgggctagaacatgtgcatatacccatgaaaccatccaaatggtataacctcttatatctagacttttcaaacaggaacctatgagtgatgggtggcttccaaggttatttaacttgcttgagtaaaataaatgattttaattatatatttactaaaaattttgtttttattttgtattcctgagcttttacatatatgctctgatactggtccatcataagtattttattaacaattcagtgttttataaaaggaattcatttgaaaaaaaggtaaccaagttattggtctcagttttgtggatgttcatgctattaattagcaatttaatagatgagagataataagctcttcttttaaaatgcaaatagcaccctctggatactaagggccaattacatgttctttcgtatcttggaatacatttcttttatcactttaggtttggcttaagtgaggaggagaaagaaagaagtggtaattttgtaccctaggatatttctagaaaaggcaagcctttggcagaagttccctcagaagggctttcaaatagtgcgaggatctgaaaagtggagaatagaaactgtaatgcttgataaaaggagtatggaagaaaaggcaggcattccacgcggataaatgttaattgttttgtaatagcagcaactatgctctgtgcctttagacactgtcctctgctttcatagcaaaagtcagtgatattggcattagcttcttgataatagtttggtaatctgggtctatttgctatatgcagtaaatactattacttggtttgattctaggatgttttagttaactgagaaattacattatatatagattgtatatgttcaataggagttcaccaaacacgctgaaattatgctaagaacactgtttgatttttattctgtaaatatcatactaacgcaaaagaacaaatattaaaacaaaaatgatttttctcctcagaagcattattttcaatttcttccatttcgtgttcagctcatgattatgtattcttagagataaacacagtgtagttaaaaattgtgttctgttttttacacaagaaaattgtgctctttttacagtgattactgtgcacatttgctacatattggaccattggaatgatgtattatgttcttttaatgtccctgcattaaacatcgacattgtttctctttttttttttttttttttttttttttttccgagatggagtctcactctgtcgcccaggctggagtgcagtggcgtgatcttggctcactgcaacttccatctcctgggttcaagcaattctctgcctcagcctcccgagtagctgggattacaggagcctaccagcacacccggctaatttttatatttttagtagagacggtgtttcaccatcttggccagactggtcttgaactcctgacctcgtgatccacccgccttggcctccctaagtgctgggattacaggcatgagccaccgcacccggcctgtttctcatttttttactgctttggttaatgaagattttaagtcatatagtatattgatcttcttttgaagattttatcaggataaagtaccaaaagtgagattattgagtcaatgggaataagcatttgtatgtcacttggtatctattgccaaattgtcctaatagataacggtccccagcagtaatacgtgaatgtgctagttttactggtcttttcagctttggattttattttttgttaatttaattggtgtccaattgtaccttttcaatttaatactctattttttattacttgaaagttaacttttttctttttaaataaaatcatcccactctttctcttgtttgaactacctgttcctattcctgtgtccatttatcaatgacttaacccatcctattgaatttgatataactatcttaacaattagtattatcttaatgcttagaagcctcctctctgcacttgcagaaatgtttaatagaaatttcaggttgatatgcttcgagataaaacctaccattaattgacttctttctttgaaatatgtttcaagtgatgagatagcaagtttgaaaacactgaattgccaaagacaaacaacgaagaaaatgtaggtgatttggtttagtaagattcttatattttgactttttttctaattttaaagtaaggtattctaaaagtattttgatccttcaaaaaattcgtgactagaataacagtactattcttttgttgttcaatattttctgtatgcaggtttagttgaacgccagtagatggcactaattacataaacaattcaacaagttaatgaagagggaaagaaatgtatgaggtttttttcgttcaaatgttgttatatgtcacatattcaacaattatatatgagcttatttttgtagtttttttctcttgtgataaaaacaattaagcccactttattgccaattaattgctactaagttgaaatacttgatactggttattgctcaagatgctgcatttgaaaagtttgtcctgaaaggtgggttaccttatactgtcatgattgactaaatcatatggtaggttaaaagcaatctaatatatgtattctgacctgaggattcagaagctgtttacgaagtattttaagacactccaactagagatttcataaaaaaaactgacattcattctctttctcataaaaatctatagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaaggtatgaattacattatttctaaaactactgttggctgtaataatggggtggtgaaactggatggaccatgaggatttgtttttccaatccagctaaactggagcttgggagggttcaagacgataaataccaactaaactcacggacttggctcagacttctattttaaaaacgaggaacataagatctcatttgcccgctgtcacaaaagtagtgacataaccaagagattaaacaaaaagcaaaatactgatttatagctagaagagccatttatcagtctactttgataactctatccaaaggaatatctttctatctcatcatggcgcacactgccttacctgttatctgataaataagtcactttgggattcatgatagagttatagctgtacatggtctcatcctagtatctcactccacacacccaatgggaaaatttgtggagggcaatatgactcgtcacttcatttcccattatatatgaatggaaattaacagcgcttatagacagtatctcctcaaactaagccttgtatccttattatacctctcttgatctctagtgcttttttcactagcatttattccaatcataaataaaaatataaattatgtaactaattgttaaatatttgtcctttaaattaatctaaatgccatgagggcagagattttgtctttctcatttgatacatccccaggtcctgaaccacgtgatataatagggagctagtaaatgttttttgaatgatgactccctttgcagaatgtacaattaccttgtgcaagctgaaaaaatagcacctgtacaatatgaggaagaccacggtgaaaaataattgagttccaaaatatgacatcaattactgaaaaaataagctcggtgatttttaacaagaagtaaaagtcaccactggggccaaaacagattttgaactaagagtaggaagtcttaggagaaatgagataatgatatatggaaattaagcggccaactaaattttgaaactgagctagacattagagagtaaaaactcctgtgaagctgaatttaagctggtcaccctggggaatagagcaactctaatcctgaattccagacagtaggtgtatagatggaaaagaccatggaaaagaagattcaacctaaagttgggaagttttaattggagccctatgaaaaagaccctggtggagaaagggcaaacttgaatatggagctgatatttggaaaaattctcatagtaactactttttctcaatggcaaggcttggactttcttctcaaaatacagatcttatatgtgttcaattaaacagggacagattaggttcaggaagaattattcacatggaatcaattggtatcagagagtcaaccattagatcttagtgggaaatatctgcttctcaaagagaagtcttttggggaaagcaaattaaagtcagagattaatttgatgagtttaggtaatataaactaaggggccaagaaaaaagcttgctcatggtatgaaactagagcttgaggacactgatctagtctatctatactactctttctgacagacccctctcttcattctcatgctccttgatggcccaagccactctctcagttttttaaaaaattgttttatcaaggtctctggattcttcatgggaatgacttccagtttatattttttggcttggttccaaaaagctatcagctaaggaatgcatatacttacttcccctatgggtaaagtaaatgagaattttagaagccaactcacatttttagcctgtacagaatctgcaattcaccaagctacttctgactcatgtctataaagttcttccctgttcttttctcacttcacatgtactctttgcaagaattcatccacttgtgtagtttcagtctgttgatgactacccatctataattccagctgagaatgatcttttgagttttagacatgtagatcctgctgctttctttcgatgttaatgtcccacaggaacttcacattgaagaggtccaaagctaaactcatctttgccttcttccaatctctttctccaaatgcaacctacttctgttgtccttgtcttagtccttttcgtgcttccgtaacaaaataccacagactgggtaatttataatgaacagggatttgttggctcatagttctggaggctgcgaagtccaagatcaaggggctggaatctggtaagggccttcttgttgtgtcatgattccatgatggaaggtggaagaccaaaagagagaaaaaatggggccaaacttgtccttatatgaaactcactcccacaataatgatgctaatccgttcatgaaggcagagccttcatgtcctaatcacctcttcaaggtcacatttactactgttgcaatggcaattaaattttaccataagtttgggaagggaaaaacattaaaccatagcattctgcccccttttccccaaaattcttgttcttctcaaagacaaaatacattcatttcatccccaaagccccaaaaatcttatttcagcataaactcaaaagtgcaatctaatataaattagatatgggtgagactcaaggcacaattcatcgtgaggcaaattcccttccatctctgagcctgcaaaatcgaatcaagttcatcccctcaccccctacccttcccagcatcaggtaaccaccaatcacagaaagttttactgatagtcctgctctagatcatctttgtctatgttcactttagctatttatcctagtgttccattattggaatactaagcatgtgggaattatttatattctactgttcaaggtcctcaccaaggtctgattgcaaaaattcaaaaaattgcaaccttaggcataaatgggttaagcagtttagggtacatttataataattatttactgtgctacttcaaaaatcttattgcctctatttataaataaaaagtgttgtctctacacagtggcttgttgtaatgcatttacttgtttctgcctgattttttctatttatacattttcttttttatttttatttttattttttcacttttaagttcaggggtacatgtgcaggtttgttacataggtaaacttgtgtcatgggggtctgttgtacagattatttcatcacctaggtattaatcctggtacccgttagttgactttcctgatcctctcgctcctcccaccctccacactctaatagtccctagcatgtgttgttcccctctacgtgtccatgtgttctcatcatttagctcccacttataaatgagaacatggggtatttggttttttgttcctgtattagtttgataaggacaatggcctccagatccatctatgtccctgcaaaggacatgatctcattctttttttatggctacgtagtattccatggtatttgtgttggtctcaaaaactacaactatgacaggatggcattttcacttttgttgttatattaaactcatcttaaaaaggaaagattaataatgtcaatatttgggttatggagaaaaagtatctcatatctttgaaaaagttctgtaactatagctttttaggtaggagggattctgtggaaagttttctgattacatcatttctcacagttcaggttagacaccattttactatgaaacactaatgcattgcctgcactgagactttcagtcacatggagaaacctaggcaaaatttttgtacacttggaagaatatttaaattagtaataaaatctttagttttaaactgttgaatgttaaataagatataaaatgtacttgaaagaaatttgctttgatatcagacactgccatgttgcagtttcaagacataataaaaaagtaaactaatgtttatattttgctgtttaagtttattaatacatcagatgagtcttcaaattctacagtggcttttgatatgatcatttttacttgccattttatatagaataaatataaataggcatttatgcttaaaaggaactaatctatctatggaaaaaagagaaggctgcttctcaactaaattgtacagtttagaaacccagatctgaacatagattattgttgtgacctatgtaggaaaatatgttgttttccttatcgtagtccttacagagtccatgataacatataaagccagaaatgtgagcctctgcaagttcatttctttgtcttcaatctctgtgaatagatatgagtttgtgaataagataatattagatgtgatattacaaattattgtgagaagcctctaaggattagatttcaaggactgccatctggctgatgactttatgatgacactgtcatgagatttcatttccttatttctgttccaggatcactctttaaacaagaaataagcattaactctgaattgtctgcttgtagctgtatgagggcttccacaactgccaactagccaggtacaaactcatcaagcagaggagatggtccttgcatcagagggttaaacatgcctagaagttccttagctaagctcccagatactaaaaaatccctctaggttctaagaaagattcagcatgtacatgtgtgtacatgtatgtgtgtacatatatacatatacgtgtatatgcatatgcatgcatatacatacaaacacattttcttccataacatctcagtattctctgttctttataatactgttttgtattttaatgatcaaaattaatagttgatcatctgaaaacattttgacctgttttctccgtctttgacaaccttgaaggcacttgtaagtcactctttgcttctctattcctaggtcctttctcatcttcattgcaacaagaaaagagaaaacaattgagccctattttgtgtgtagcaaggagctactctagttaaacactagatctcttttacattctccaacatgttgttttagtaattattctactttcctttttttgggatattcaatttcttctttctttttgctcctcccctttagcaggccaacatactcaagtctccctcatcctaagagaacttttttagtatatcattttttttctatccagctgtacttgcttctgcttactatatcatttttaagcagtagttggcattactgtttcctgttctttagctactagttgtactttgacccactccagtctcacttccccagcaccaccactttatgaaaacaaggacttactaagatcatcagtgactttgtaatagctaattagtgtattttaattcgtccatcttcttgactatattttaacattgatcctgttggtcaactctgctaatcaaaactttatcctccttggttcccagaacaatattatcttgaatatctcatttctctaatcatataataattgtgaggtgcttggcacaatgcctagtgcgtagtaagaactcagtaaaatatcatctgccatcgacaccataaaaattaatttacttactcaacaaatacttttgtatgaagtttgtgctaggtaggcccagtaattggtacttggtatagagcaatgaaaagccctaccctcataaagcttatattcttggaagcagaagttggaagacagacattgacaaataaaaattaaatacatgatgtgtcagatggtcatacacacagtgtggaagaacaaagaggaaaacaagtggagagagagagggaggtggaagaggagtgctgccatgaaaatgtggtaatcaaaaaaggtcttactgaaaaggtggcatttaagcaaattctaaaagacctgaggatgtgggccatatgtataattgggggggaaaaagtagtccaggagagtcctaataagttaaaatgccccaaagcaggaatattcttggcatgttgaaggaaccttaaaagggagatcagttaggcagaaaaggatcaagcgagcaggaaggtagttgacaataaatttagaggggtaactggcatctgattatattggccttttaggcctgtggactttagcttttaatctgaatgagatgggagttattggagggttttgaatggaggagtgacatgttttgtcttatctggctcctctgttacaatagactaaacagaagtagtgagaccattaggaaactgttgtcataattcagtcaagagatgactgtggctgggatcagaatgggagaggtgaatgtggtgaggagtggttggattctactatattttgggtacagagcacaacagattttataatggaataaatttaggtgtgagagaaagagtcaagaagactcaagaatttttagcctgagcaacggaaagatggggtcatcatttactgagatggggaaggctccaggagtaacatattttgggaggaagatgtggatatgttacatttgaaatgcctattatacatctaggagatgtgtggagtagatagctggatatatgaatcttaagttatggggagtagctcaagatacaaagttgggagttgtaacaatgatcagtgcaagttctctgtcttcaatgcaattttaaatgttgatgttccattcttaattgtctctcttctttctctctgcacattttgagtagctttgtctgttggcttcagttaacattaagactcctcagtgtcaacttccatcttacactcttctcctgatctccagaactgtactttctgccacctaacctacattaccacctggatatgctacaggctgcaaaatgtgtcaagtagaatgcattatcttgcccctaaaagaaagttaaattttctgtgttttcagtgtagtgtaattgtctaacttaattgtctctaaaactggaaacctaagaattaccttctacctttctcttgatctctctttcccaatctactgacacatgtattaaactggcttccaaattctgtgaattctacttcaaaaattgctctagaaacaattccctctctttatccctattgtcacctcatcctaaagcctcttcatcctttgtagatttctgggagattgtaaccaacttttctctattctgccagttatcaagtctttacgctcatttgacattcacaacagccttggatctgtcttccttgaaatgaatcttcttgcttccctttgattccagtgctttttttttaccctcctgagacttgatgcatgatatttacatgtatgacatgtttccaaaagcattctcaaatttttctgaaagtaaaaacaaatgaaaaagtaaaacattttcctgggaagaaaagcaaatagtgttatacatttttgcttgttcatttgtttgtttatttaggagagggacaagcattagaacttcataagagtcttatatgctgtatctacaaataccgtcccttggcaatataattttagagttccttttctggaactacttaaggactgttttatgatcctcagcagactgttatattattttatagccataccttttatttgctgagtaattgtactcaataattgtttgtaattgaatgaaacaattcatcagatgttgggcactgaatggctttggattatttccaaaaatttaaaggataaagatttgctgccttcaaagctatgtacaaaaatatgatagaatgctagcgggatatttgtttaaaatacaacctttattacattggggcctgctcataatatatatgtggcacattttatttaaaatattaaagttcctggtgggacatgtccccataatcccagcactttgggaggccgaggtgggggtgggaggatcactagaggccaagagtttgagaccagcctgggcaacatagtgagataccatttctacaaaacataaaaaaaaaaaaaaaaaagccaagtttgtagtcccagctacttgggaagctgaggcaagaggatttcttgaacctaggagttcagttcaaggctgcagtgagctatgatcatgccagtgtactccagcctgggtgacgtagtgagactccatctcttaaaattaaattaaatttaaagctacaaatgaccccaaagccaccagttcaaccctctcaattttgaataccctattttaaattcctcttatgcgaaatgtaccttgtagtccattttaaggactgagaggatttggtatgttaaaaaattcaatccattatcaactcctttaggtacacttagcagtatgaaaatgtgtctttcggctcttcaggagagagtcatatgtatagttacaagacaatcccatttttatattgctgagacccaaatcttcccaactgattatgaagcataagaactcttcggaggtttaagtgagctgagattgtgccactgcactacagcctgggcgacagagcaagactttgtctcaaaaaaaaaaaaaaattctctgcattctacagtagggtaatataacatctatgatgtgaaatcttggggctccgggccagagagtgtcatgatccatatggatctaaaaggttcatagtggtaacagcctgcttcattttatgtcatctcctttcaagtaattagaatgtttctagcttgcagggattgcacacaaagggagacatttggaaccatgtcattggtgatttactggtgtggaaaattacctggtgatgtagccaagtagccattttcattctaacccagtcctacagtcctgaactgggctgaaccaacgcaccaaaatatatgcttagaaatgctcctatgtatcagttttcccaggaaaaacaatagtattatcgaaaacttaccattgtttcctaataaaaaattataggataccaacagactgttttttgttcataaatttaatattacagtatcaaatattaaagcaaatgggagaaagtttttcttatttggtttaattgaaccattaatgttagctacaatacccatcatgttacttttcaattatatttatattttcattttatttctatctgtatcattctcagaaagacttctttaaaacattcaataaaaatagaatttaggtagatttatttttagaaagttgagtttttttaataaatgaatataatcatcacttgacttaatttttttctgcacaattctagaaatcttatagttttgggatcctttggctttattcagtatgtaacagggatctgtttcctttctctaaatcattaattcaaatgatttcttatattaaaaatgtttggacatataggtattaatgagttttatgaaatctaatctttccaatttccccctaaaaagggatgtcatttaatcagttctaggttgtgatcaatagcagatttttttttttttttttttttttttttttttttttttttttttttttgcagctccctttcaccccgtagggaaacctgatatcatccttgactaattgcagcaaagagcctggctcaggtcctttgtcttataccgagtgtttatagattcttgagcccagcagaatctgaactcctggctactgctacctacttcccagcccaggccccaaaagccctatgtctgcagccccgtgcaccactgtgtgtttttgtggcatttctgaaacacagagctacttaacttgtttctaagcccagattgtgcctttttgattttctattttggtattttatctaccatttttctgtgtttggatgtttcttctatattttgaaataacttctttcctttagtacaagtgattcttattgtagaaactatcaaaaatttacaaataaagaatcattctcaacattcttagcaattccttctatcatatttttgcaaatatatttttgcctatttttattttacttactccctgtttattaacagttaaaagcattttcagatagttttattttttcatttaaaaaaatcttaccacatttttattaggaaggaaatggacaggtgtttatcttttcaataaaaaacatgggggaaataatttcttgaagtacatagtgacattcttccagccaatgttttatgctgtggtcattccgtctgtcatcagtattcatagaaagagatgaaaattatttaaattaactaggaaatcaattccccattcaaagcagtagttgtgtgtttcaaatatcttctaatagtcagtttcacacttagctttatcaaattcctaattatgatactcattacatcactctgtgtccagtcagtgtgtttatgccacagagcaattaaagcaaatcaggtgaaccaaattcaatcacctttgtagataataacctacgttgcttaaacttatggccgctcatacaattactgatggattgcctttttcttttatattgccagtattttaaatgtcctagtgaagttggggtagctgttgaacttcaactttatcacaacctcttttttaaaatgtgtaaacgaaaaaaccctccatgaaatgaccaaatacagttttcatgctgggacaaattagatgaataataatcataaattcataatgattatttatgattttatgtttttatagtgagatatgttttgttgaaatgtgttatataagtgatacttaagtttcctattaaaatagaaatgctaaaatggcattgttctctttagctgtgagtctagcttttgacctctgcttaaacggaactgttgttccatcccaaatctgcaactctgaggcctatgctcccttcactgctgtctaatggatacctatcaatttggaaggaggtttcaggcagctattcccggtaatctaatctcagctctgtccttttcaatattttcatcagtggcttggatgaagacatagataacattcttatcaaatcaatgccacaaagcagggagaaatagcaaatatagcagacaagagtatcaggagccaaaaagttttcaacaagttggactggtaggctgaatactgaaagatgtaatgtaaatgcaaggtgctacatgtgggttcaaaagaaacatgaaacaaaaaacccatctaacttagactgggctccctggaaatagactaagatagagagttgtgtgcataaggtttgttgaggagtgttcccatgagatacatgtgtaaggttgtaagataggcaagattgcacagacgaagaagtgcagtgaagcctgcagtgcgttgcggcctcatcagattttcaggggagttctggaaattgcatggccctttagagacacgctgaattgaagcaagggatctggacctttgaacccaatactagagagttaatggtcctgggtcaccccatgggaaagagcagactggagtaagattgttacctacagctgaaggcaatttccagggagggaggcagctgtgagctgttagtagtcaatattccaaccagctagggcatgaggtcttggcagagcaacagtgtacccaagaccgcagtgttacccaaagtatggtcctctgactggcagcattggtatcacctatgagctcactagaaatttaaatttgtaggtcctaccccatccaactaaatcagaatctctggggatgggacttggggaacttttaacaagctttcaggcctccaagttatttctatgcatattaaaatttgagaaccactgcctacaccaaccaaaaacattccaaatatggagataacatagagtttttagcaacaataatctccttctgtttcacttctctctttacacacacacacacacacacacacacacaacacacaacacacaatgtgatagaacagtgggaaaggaaagccaaaggggatcttaggccgaataaatttaagcatataacctagtcctaagaacgtatatttcagcttaatagagagaggaatattgttataaagctgtccaaagatggaacaggctgccttgtaaagttgtagaagtattcaggaacaggttggtgataccttggtggttgtatggtataacatcctgatcttcacatactcatcatctagagtgggagttttctttttccaaatggggttttggcagaactagttccactgtatcttaataagtaataactcaagaaagggttctatggatgaaaaaatgattaggtaatatcaagttaaatcaaagcgaacagacttctttcccataggagtaatcagacccttattacagtgcatgcttggtgaatcaacaaagtatgtgtatttatgaaagtatggggggaagggataatctatacagtatgcatcccttctaaaagtttgaccatgaaaacaatttctcaagaatcttatacaacactacagtatctggtccaatactatgcatagaacatgcactcagtaagtgtttgtaagatagatagcatagcatataggccaggccactgaagggaaatcatctcaccgtgagttacctgaatagtattctctagtgccattagctcaattcttcacgtaggcataagcctatacatttgccatgctaaccaagggaatttgtgttacgtgaattttgactctattcagacatttttttctatgactcctccaaggctgttattcttacctcatattctggtagaagtttaaggacttttttctgggaatattgattaattagctagctagctagagacagagagaggatagagattgattctctggcagagcctatttgaatcatattgaatctttttttttcctgagacttcccacaaggaggatggaggagaaattttttagaaatccaccgaagtaatcagggatatcttcagtaaaagaagctatacttaataaagtctctattttagcagatggcaatcaacaatagaggcaatagacaatagagtctattaaaattgctgggatctgctaataacgtttttcttttccctgaaacaaatgccattaaccctccttgacactctgtcttcatcaacattctaatagaatggaagtaactcataattttgaggatttttttcccacacaaaacctataaaccacaccacgctagtgattacttttagcctagttgctaggttgctgctggtaacagtaaaacttatcctgacaggtaggcaattccagaagcccagccaagcacttggtgtgtgtgagtaaacccccatacacttctcatgtagagtaaccctggccaacccataactcttagcaactattcctggtggacggacctggtctactctaagaagaggccaaggttctttaatagtgcagttgcaagaaccagaattgaaagtcaaagttctagcaagattttgcagactccttggcaaaccagtggcttgggactcattcttgacttcaagcccttaattgataatggtaggacagcttgcttgcgctgggttctgctccctgggatatgcactgtttgccaaatgagtagcaggtggacagacatctttacaatttgctgtcccatattctaaatgaacgtgacattctataggtctgagttaacctatgaagtcaccaatttcaatatcaaaatatttatgacagagaaaaggatactgaggcacagagagtctgtgactttcctaagctcaaaacaccagtttgtgttaattctgacacagaaattcttgtatttgctatcagtctcctttttctgtgtgtgtgtgtgtttttacattgcagcatcacctatatgatgttaggttctgtaactttttgagaattttctcacatacagtgatgtgttactttttgatatttcaaatagttctagtaagtcttttctacttttattagcgtattaacatactggctctaagagggcatctcaccacatctttgccattcttcctggaaaggcaagtttctctccatcttcttttttgtattccaaagttttgccaaagtttgcttttgaaaatgggttacctggcagagctttattattctaactttgaaagtacaagtcagaatcagacagtggcagttatatatgcactactgtgattactatataatgaaagtatctatggtgaaaatactgatactgacatatatttgccattttctaattaagtgcttcagtaaaaattaagcactcactctttgccagatactgcaatagatattgagcacattgaacaaaattctccatatacatatatatgagtccacattctatgaaagtataatgtttttctgagaaaaggcataatattctattaatatcagcttttgcttcttccaccatatattgaaagaattctgaatactgttataatttaatgggagaatctagagaattctgtatttgctttcactgcattgatgaactaagatttttaaaaaatgtattcttcatagaactacttttccatatttacctaatattattcttatatcatttgagcacatatttcactaacaaaacaaatgtgcaatgttattagttctaacatcaaaattacactgatactttaatttttatcctattatttttcatgcagattaaaataattatagctacatcacatgttgcaagttttaagagctactttaaaaatatatgcttcaggaaagacatgattagatggggaaatggatgatgttcatattttcaaatgaaaagttttaaaaaagtgcctatcacaaacactaaatttttacataaattatcaactactaatatatctacaagaaataccatttttccctacaaaaactcttaacaataattgttaaacttagtcctggaacctgctaatataatcggacaaatgttgtcaataagaaggtgaaaaagaaagcatatatagtttatcaaactataaaatatagtttatcaaaaccaatttttcctattgacatttattcaggaaggaaaatggatgagtgaaatgaacaatggtctctaagagaggtgggagatagcaataaattcagaccacgtttcctgtcattacagcagggaagtaaaagagctacagtcaactctcgaaagtacttgggggaactaatgattccctgtagacctgtgatgtttttgaaatttaattcaacaatttgatatacaccgcaaagcgaacagatagtcagatcaaaatcggaagaacgattgtctgaatggcatccatttttcctagatgtgctgtcccatcctgtgtcaattaaactttcaggtgatcttcaaacatatttccaagtaaaaggtattgcagttatcctataaactggcctcttccccagcactgcttttgctgtggtcaactttatttctttgggctcacaaaactgatagagcaaaataaggaaaacggaacattggattaaaataaattaattcccattctgtgactcactaaaaaaaaaatgataactatgcttctgtgagcattaataaggaaatgaataaggaaatgaccaaattgttcagtggacaacttgtatgggatttttaagtattgtgtcatcatcaatgttgtcaattagcatatactttgaaatcaactaaagcaaatcagttgactaatcattaagggtctttttaaatgacaacatctaaacagcaaatgttttattttggaaaatcatgacagcacaagaatgagccagatgttttacaacatgatatccataatttaaagtatgtagtagtcactcaaaggatttctatttcagtttccttatgatttggctaagctagaatttggaaaaacactttaaggtaatgtgagaaacagcaaaattcaacatgtggattttttcactaaagcttatttctgattattttttacaaactttactaggtatatgttaacttcatgacacttatagcagtggaccgtagttttaataaaatgtgaatgtatactcttttctcaataatattaaagaatgttgactttcgtgaggatatttttatttttctcaacattaagaactgtcaaagatttaattctacaacagaagacgtgaattttgttttctaaaggagaacagaatctatagaagaagtgttgctcatagtactcagattgttgaccaatcttaaaggagaaaccgtcaattaatttaccgagaagtaataacattatctttttcttcaattatgcacatccacaaagatttggggcaaaatccacttaaatgatattatacataatagatgagtattcatatgttgtaagagtcctggcttctttcctgcaaaatgattaaaacttggatcagaaaccaattaaaaatccattctaattcccaaatgtatgtaactgtactataagaaaaataaatatttcttcttgagggatatccattagttaaggatattcataacatggtgtcttgtaggaaatgttaatctttgggtgaatagggatgtttgggaataacaagactcaaagagatgttgcacttactcacttttctctgagttgttatttctgtcatttccccagtgcgcctgtcctcaactttgcctctctccttattcctttttttttttttttttttttgagacggagtctcgctctcttgcccaggctgtagtgcagtggtgcgatcttggctcactgcaacctctccctcctgggttcaagcaattctctgtctcagcctcccgagtggctgggattacaggcacccaccaccacgccctgctaattttttttgtatttttagtagagacagggtttcaccatcttggccaggctggtcttgaactcctgacctcgtgatccacccaccttggcctcccaaagtgctgggattacaggcgtgagccaccatggccgatccctccttatttctttttatctctacctctgcctcaatggtatttctctattactgttagcatttgctttctgtgagctcttgcacactgtcagcttatatacatgttcctgttcacatgttttcctgtccccagtggttacaacatgtcttctatctcagcccactctagaattgtcttacttttccaggtctcctgctcctcagtatttttcccacttttctagattcatgttttcccatctgcatatttctcttccatgtctgcactgtcatccgcttagaagacagcgcataaggacactgttatctgagcaaatcttcagcacagccaccatgaagcatggttaccttgtcactttccatttttcccatagtgtgtgcaaactgccctgatctgcatagaaaggtatcataattgaggaaacaaaatgcacaaaaatgtccttggttattccacccctcagaaatataggagagaagtaatttacagaattacacagaataacgctatgtcacatggacatggagttatcgggttagcatataattggaaaatatttcctaggaccttgacatttactcactttttgttttcaaattacatgtccctatctattagttgcaaattattttaatgcaccgtttaccaaagaaaggctgtttcttctgaaagctttcatttgacaagtaacttgtaaaaatattcacattgtgtatctgttttccccttctagtccaaactctagttatcttaaactttgcgcagttataaaaaatcataacaaaaaaagcttcctcgttgtcattcttgtcaaaacaggtttaccagacttaggtaaacttaaaatagttagtgtaaaagttaaaaagctgatttgctccttccagcgtgtttgttgcctttttgccacagcaaaattgtaaatgtaaacgtattccctaggagatgagctgggctgcaattttcagctaattgggagaagcagccctgagttgagcactgtcaggctgatttgagtcttaagatatgatgatgattattgtgtcaaatgtaatcaagaacgtgggctctgaactgactcaagggctggctgtttttaattcaggttcgtatatgaagtagacctccggttcaccgatagtcacagctggttgtagaagagagcaatttttaaaatgctatttcattctctatggagctctagggatcagagattggatgcacagggaggggacacatcctcattctctcctgaaaaattctattaattttcagtataataaactttctcttgagattccccagtggctctgtatcggtggttttcaaacttctcagacccaatgccacccctcttttcttttttaaataacaaatactttgtaataccttctttacgattataagccaaaatatgtagacaacataccctacttatacaggcaatagtttaaatgatgccgtaactctattttaaagagaaataagagtcatttataataaaataatatgtgttgtagtatgcagttattcaggcaggatcacactggaacacaagtgaagtttttagatcacgagactatcaatgcagtataaacaaatgcagaatgacaccattgtgttgtatggagactcaaataccatgaggggcattggtcatccatagcgtaattttccaaaatgctgaacaactcttggcaaaattcctaacaccatgaaataaattttttcttggatcgttatggcagttagttgcatggctgaaaaattcaatgtcttaaaatcatgaggaaaatatcttatgtttacgtgtaaaattgagttacgttccaggtttaggtgtttataaacagggtttccacatacatgcatgtccagtgggatattccaaagtgctgtcagacttgggagagttctttgttgtataagaagtctaccatcttcattccctctccacagaatgctattatagtaacactcttcaatcactgtgatagtcaaatgtcctccctcaatttctaggatgcctcttttttttgtggtctgtataatttggttaaatatctttccagacaaatactgatttgtgaattaatgaaatagcagtattttcggagcacctaacctatttctgagtgatacagttgccatttttacaagactaaatgaaattaccatttcagacctgccagattgtctagcccagtcttttacaattctgtgattatcactgcaattataatctattttcaccacttgaatggcatgatctctataaaagggtggtgataacactcatctattctccttcccctcacatagctatatcaatcgccccctaaccagttgttgataaatgcagttgaattttatgtaaaaattataagagatattattgtagctgtccaagacatttaaaatgctaaatgcaacttacgtggaggctataagagaaatatgaacccatttattgaagagattagctaatttagtaaaacaacacagatatacctgcatacagggataaatccctattgtctaaattattgagataaaataatgttttacaatgaaaaacttttagacaagtaggtaagtaaaatgcagcagtctatttgcatttcatctgggcatttgacaaagtctttcgttatactcttgtgaataagttggagaaatactggctagatgcaagataaattggatggcttagaagccacttcatgattttacgcaaaggatgtcgattaatagaccagtgtcaggtggtgatggaagatctctggtgctatgtcacaagcttctgttctcaaccctgacacactggatgtttttgacagaacatgagtagaactacagagaggaggcccatcaaacttatgggtgataaaaagcagggagggcaggagtattttgggtgacagaagccaaatgggtgtctggacaggatgcgttttaaggcacttttggtacttgatgtctgaagaccaggatcaaacttataggcaatctgaacatttgccaaaataacaggttaattttgacagaagttattatttgtatgctgtctatttctttaatacacctagaaagtattgaaataacattttttgcagacactcattttgaaaattcagaaaaaaaattgttaactttcgtggaagagtaacagaaactcagtcattgacagctaaatacaatgtgttgcccagtaaaatagtccaccccttcactttcatggctaatataaaatttgatgaaagatacaaattccaaagattgaatatctgtacatttgcaaagcaaaacacaattttgggcacagaattgctcattctcatttttaaacatcttggttataactgaacaatagttttttataacaaagataatattttcaaattattatgaggttcaactgaaataatttatgtgaaagcaatgtctaaactctaaaattctatataaatataaattattattcaataaattcacatcaagaaaattttaagttttttaagaacaagagcctatggccttgtttttagaagctgtataccttatcggtagtaggtttattgactttaattaaatttattgagtatctattaaattgccaggaactgtggtgtgaatctttgccctcaaataatttacagtaagttgtggttgatgaatggtgatgacgatgatgaatatccagactatagtaagtggtatattcataagtcagaggattcttaaaaccagatgcaccctcagattcattcctttcatgttgtacttctaattgaaaaaaataaatcctaaattatgactgttctttataaattttaattgatcttataaaaggccatcaatacatttcaaagtatctaggtcttttaaatgcaatttttcaccctggtaattaaaagtacgaaagcaagaaactttaaatctttattttgataagttttaattagctcaagctacttgtaatcccacatcttgtcttgtaaatcatatctgagccattaaaataggtttacaattagaagggcaattcttttagaatctacttaaactaagtcacttcgacaaattaattcatcgttcagttggttttattaaaatgtatttatttcactgtaaaatgtctagtaaagcaatgtatgaagtattttattttcatgttagaaattttatgtaaaagatatcccaaaatacatagacattcagatactctctgtatcattaaccaacatttactaacttatcatttagagaaggccaaaattgtatgtactataactttgtataatttcataagaattaaaatattcgattaatgcctgtaatgccttctttctaaatcaaatcctcaagcttacctcgagttcaaagttcagtatttattgtaacacatctcatagatgacggatgaagatggtaagcaaaggaataataatttcttttctcttttcacacatatatacacacataccccataatcctaattcatataataataacagaaaacaaagggcttttgagaatagtgacatattaatatccattatatttacttcacagggagactggcaagtctaccttgagaggtaatgtcttatagtacagtggactagattgtttcaagatttgtcatttattttggcaactcacccagcttccctgaaagttaagttcctcatctataaactgttcatgataattacaacctgcctcattagcctcatcaagctatttaaaatatgaaaggaggtgctatctgtggatcctgtcaaaggagcttgaaaactgcagaacattattttagtgtaaaatactataacaatacatgttgaatataaaatggctttttcttaacttttattttaagttcaggagcacgtgtgcaggtttgttatataggtaaactcatgtcatgggggtttgttgtaccgattattttgttacccaggtattaagcgtagtacacattagatatttttcttgatcctctccctcctcccaccctccccactccagtaggcttccacgtctgttgttcctctctgtgtccatgtgttctcatcatttagctcccactaataagtgagaacatgcagtatttggttttctgttcctgcattagtttgctaaggacaatggcctgcagctccatccatgatctctgaagaatctccacactggttttcacaatgactgaaataacatacactataaccaacagtttataagcaatgctttttctccagaacctgttatttttgactatttagtgatagccattctgactggtatgtgatggtatctccttgtggttttgatttgcatttctccaatgatcagtgatgttgagctttttttcatatgcttgttggtcgcatgtatgttttcttttaaaaagtgtctgttcatgtgctttgctaaaagggccctttcaaatgtgtattattaaccacaagagagtactgagtaagagactaggtaataaaagtcacaaatatttcgatatcataattcagaatttagatcagcggttatgaaattgttcgtatttccaaattccactgacaggactctactataagtttatttcatctgttgatatgtttttagccacttctttcttttaaagtgaatctgttgtgtgtttgccatttgatattagaaaactgaacctgcctgctttgctgtcttctgaatattatgtatcaacaactaacaagctacagttagttgttttgttctgtttttctctaagttattgtggatgaggatatatataactgcacagtcttatcaggtttgtaagagatgatcttaggctcatcttttaaattggtttttatactattttaaacaaatccttttaggagagaagaaaagctgcttagtctatcaacattaggaaatatatctttaaagagtttatcactgcaagtaaccaaagccaacttaaaaattcgcattatacaaatcattgagaatttatttagaacagaaatgtgtccaactataggtcaacaccaattttaagtgtgtaattatctgggaagtagtgttaactgcatttttttctaaagatcccttacagttgtataaatgcccaaaaggatattttgagtctctgtatattaaccaaaccaaatgtaattcattactcccaacattatatttcaacctctccaaatagtaccttttcgtattgtatcagcagaaaaatataaaatgcagatcttaaagagtatcaatctctttaaaaattcaagaaagaaaaaaatatgtgtgtatagagacgtgtatttcatctgctcataacactgtgtacatttctttatcaactaatttttttcagtgatttatgagttgaaatacaaatcaaatgaaacgggtaatgcaaagtaaagtagaaaacacattttctactgctgtctcctaatgcaggtcttttcaggaaagtactaatggttttagggaaagtgtataattatggttgtttccctaatgataaattcgcaaatctctattttaaaaacattcataaggttaaaaaaatgagagatgaaatgtgtctttcaaaattccttacgtgattgataatgcctatactctcttactatctaaagtctaggtgatatgtatattttttttaaaaaataaaatgtctgtatcagtgaaggaagtttacacagatagcttcaaagctgtggtttatctttggaggattaatctatttctcatgccagtgtgttgctactgcacatgttaaaaagtcatcctgtggtgtctggggtgacaaaagatgggaatgagttttctgagaactaatcagcaatactttgggaacatttaggtcatggtttccaattaactctggagagtttgagtaatttagtaccagacctcaagagagaggggatgaaaacctcgttaattcatatgttggtgaacggcaaaccagcaaatttgcattaaaaatggatttttattttaaagcaaagagcagccagatcttttctgcaatagtttgggtaggagaatatctttgtatgtatgtgttcccttatgtgtaggtatttgtatgtttcaacgaccctgcatatggcaataacagaaaattaaatttgtgctctaaaatgaagaccaggattcagtgacataatcttccttgtgcctttctttcttttagtacaatgaatatatcagagaggagtgtattccaatatctgtcttcagagttacaaaaacttcttttctagaatgcaagacttgggctatacccccagctctgccacttaacttgtatacaaccttgggaacatcattacaattctctcagaatcaatctctccagccctaaaatgaaaccagcaaaagcctgtactgtatatctaaaaggttttttatttttatgaaaattagttaggcaaacttttgttaagcatccatcactctattttgagataaagccttgctggatgatctccacctcttttgatggaaagagtaaaacatgtttaagatacatttatcacttgtttggcaaattgagatagaagtttatgaaagcagattgatatatgttacatttgagctactgggaaggactccagatggtttatagccttaattacattgtaactctagttaaatgtttacctatctgtaccctctgttaaacttgaatatgttaaataccaaagtccatgtattattggattttctgtcaccatcatcaggcacagatcctggtacacaataggtacggaatggatgcatggatgaattattgaattagatgttggtaggcatgtggaaataagaatgaggttcagaattaaagataatctgtatcgagtgtaaagccattggcagagaatgaaatatccagctgagtatacatagaaaaagaaggtaggtagaaaaatggaaaatatcttatgaagtgatgatagaataactctgaatatgtttgaaaacatataaagagttatgtggatgttagctttaaaaattatcttccatgctgtacattagatctgccattcttcatgctgtggatgaaaagcaagcatcagaagttaaattaaaatgatgtcatatattcctcgccttacagtttcataacagaggagaaaagagaaacattctctcattgccaccacccttctccagtcatatttctaggtagatgttgcccaaaaacagataaaaccacagagttggttttgctaggaatggactactaatccaggcaatgttgacagcttttgcttctcattagtgcacgttactaatagaattgctagagattaaaaggaatcctttctacaaagtgctgtatatccataggtgacaaaattctagcttcccctcacaagtacaatataaagttatgttttaaaatcaaaatgcaatttactagcaaactagtaggaactgttatggttacaggaaatttgaatttcagattaactctggttctatgagtagcggttgatatggcaagaatcattttgatcttacatccaggtgctactaaggtctctctgacctatatctcaccaaaaaaaggaacaaaataatgatcctttaatctttctcctaaaatatcataggaaatgatagtggctaaattgcaaataaactaggaaggaaagattcagagtattttatgtgattactctataacaatgccaggccatagtgaaagtgttatttagcagaagactgagttctttgaatgttcctaatttatcacattttaaaaataacctgggcaaaataacctttcatatcagattgagcctttttctaaaaatactcaatatgtttctgtaattatacctacacacttacaattccacagtataatgcaccgataaagtatttttcatccatatatctaatagtagaatggtgtgtatacaataattaagctctttaggcttaccccggaaagcaacaagtttcccttcctttttcctttttatgtattatgttggccataagaaattgatgatattcaactcaatgcagtcttagagatttattcagaaataccatggtgtgtgtgtgtggcgggagtagggttctaatgacaggtcagaacttacttatttgatttcttcattgataatcaggtcttaaaaagaaaatgggtatgctgaaaacatgccttctgtgattctttaccttcatgtgcagttgtctctggataaacactttctttggcacgtatagggttgcactaagctttatagctccaacactccgccccttcagtagattcttgcttgtaactgatgataatgcaaacctgtattatctataggtctccttaaagggcaaccaaaagttcagtagcaattcaggcacaattactgcatgtgagaatcctccatcttgttccctttggagaccacatatatttcttaggcaagtatatttttaaaatccttgttcagcatgacaattcaggaggtcaagttctcccagaaagcagattctgagaaagtgattagcatgaaggaattttattggagagtgctctcaggattaacacctgtgagcggaggaaaggaaagggagcaggattgggcagaaggagaagctgggctaccatacagtcacaactacaacacaatcaaccctccgcctctccttcctagccttccccaggaggatctctgaagtctgaaggtagaatagcccttcagaattgtcctgagttgcagcaagggacccaggattttataccccacaactctcccatcaaccaatacgtgcagcccgtctcggggacatagtgggtaactttgggctaggcacctctctttagctgagtccagctctcagacaggaataacagctgaggactgtcagccagtagcactaccagcagctggggtcagaagtatttcagtcctgaaaaggggtccgggcagcccagcttagcatctactatgccagtcgttctcaaatctggttcctggcaactgtgattctcaagctttagcatatattggaaggcttgttaaaacacagcttgccggattttacccacagagtctctgattcagtagagctaggctgaggcctgggaatttgcatttctaataacttctcagacgttgctggtgctgctggtccatggactatgagaacactgtttcatgctgcccttatttacatactgagaatggtacacagtgctcttatgaatagaatgaaaaccttttgaaatcacattattccttactccatcaaattctcagctatttttgtgcaccataaagctggaatagctgattataaaactttgttatgtaaaaaagtacttaaccaatacagtagattctgtttgcaaagcattattacagtttctaatatctggtcattgttacttgtaaaattcagccaaattttctccagggcctgtagtttgataacttggacaaaggaatttaaaaaaaaatctaattcaagacctttggttttttttctgaacatatcttttttttctttatgattcttatttttacattttacttatcatataagccacttaaacccatatggttccggaaaatttaaaactatatgatacatttagagcatgttgaatgcacagatatggaaattaagtattcttgactcattctagactagacctggcacaattaaaatttagggattcaacgtacacacacatagattccgagagaaatgttgaagccgtaaaacccccacacaagcaggaaacaacagtcttacctattattcaagaggcacgtaaaggagctcatttgaggagattttctgctgttattgccatcgaatttttaacgtattttccaaattagaaaatattcagcctgatgttgtcaatatttcagaccacaagggtatcatttaggaaaatggtttcttactgtcctgaaagagttactgttcttccctaagggcctaatttacaaagcagcaaacttgctggtaggatttggctgaaaatcacattgtctcggtagaactctttcatctgatttatgtgcattgcattttgcaaataactcttggaaagttatttactagttactttctctggaagcagagggtaagcggcatttctagtttaaggatagaggagctaagatgcatcaagcgcagctcatcatgaagctgatgctgataaaatgcacaatattacattctctaagtttcactctgccatgggagaatttcatatttttaaattttgtttgaaattggactacattagaaaatatgtcaaatgtctaaccctgcatttatattctggaatgtgacagcttatttctgttccaaattttgcactggagatggagtaagtcttaatgcaaactgcatgaaactgccacttttataggtcacacccagtcaattgtcagcagttacacatggttcaaactgtaaggtgtatgcccaattgtagcattgagattcgtggagttgttgcagtggttctgaatttttcaagcatgatacataaaaagataaatgactcttttgatatttctccttgcattgatagtttgcctgaaaactagataagcagggagccggcagtccacgttagcccttgaactacatgaggtttaatttatttgcccaaccagaaccctacactacctttcagctgtgcagtattaaagtttatttaggagttgataaatagcttagtgcaatgcttccttttttccagtagctacatcctcataaacctattctaccctccaccagttaatgcagacagaagatttttatccagtatgagcactgaaactccactgtggaagactgtgtgctcagcaaaaacctcacccatgatgaataaacagctcttccgggggctttgctgccgctggctcggcaggagttgtttattgcctggtttgcacatcccatgataaagttgctgctgaaataaattgcagttttgcataattattgacaatcacatcttaacaagcaatgtgtatcatattcaagtgttcaattttttaaaatccatttttagcttatgtttaatcccagaaagtgtttgtgtagtaatagaaggcaaataagacatttaaatagagtactaatttcctcattgcagacaaagtttacctgaatctttttccataggactgttactgcctaaggcaattttcctttctaagctattattatatagatatttgctgagggcatatgtgtgtgtatccacaatacatgcattttatatatatatatatatatatatatatgatcaaaaatatgaatacatttttagagtttttgtcatgaaagagtttgtttcatctttttaaaatattacaggaatggggaaatgggatatgggtagaaggaactaatgtttttgagtaactgtaatgtataactgtataacgtggggcactcaacttcacaggaattttttattttaattctcatcacagcaatagatattgcagatgagaaactgagaatcagagagggaacttgccatatcacgtaagtggtaaagaacactgggaattgaactcagatctgcctagtttttaaaactctactctttttcattacacataacatttttattttggaaaatgttctcagttgtatgatcaagtagttaaatatgaaactaacacaataattataactgatgtcatgcaaaatgatagtttgcacaaaatgatagtttctatgaaatgttatttctttacttgttaagtctttcttcctttgccctccaatccccttctttttgtcttttcctctagtcttttccttttgattctaggtttgtattttcttgacttttctccttgcatatcaaatccttgttttctgcctcagagcagcatcaaagacaagcatggtacagggattttagggttttaactataaaggtttgtctcaaatttggcagtatattaaaaataagctttcaaaattgaccaacaaaaactacaaaattgaaaaaaaggtactttgaactttcacatgttcaaatatatgtatatatatttcacatatatatatgaaacctcctctgtggagaggggtttatagaaatctgtaattgtcattcttgcatgccttcccccatacaaacgcctttaagttaaataaaaatgaaagtaaatagactgcacaatattatagttgttgcttaaaggaagagctgtagcaacaactcaccccattgttggtatattacaatttagttcctccatctttctctttttatggagttcactaggtgcaccattctgatatttaataattgcatctgaacatttggtcctttgcagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagtaagtcaggcatttccgctttagcactcttgtggatccaattgaacaattctcagcatttgtacttgtaactgacaagccagggacaaaacaaaatagttgcttttatacagcctgatgtatttcggtatttggacaaggaggagagaggcagagggagaaggaaacatcatttataattccacttaacaccctcgtcttagaaaaagtacatgctctgaccaggaaaacatttgcatataaaaccagagcttcggtcaaggagaaactttgctcagagaaataacttagggattggtttattaaattttaaaagttgacatttttgagtgtttatttaatattttacagggaaagcatctgtatgaattgtctgttttatttagcgttgctaactgaatcagtttcccttcattactttcaaatatgttttgaaatgttaatctggcattttgtagctttcttcctaacatgatctgtgaaaataagaatgagatggctgaatttgtcgtagttaatgatcaaacaattttcagacaattgtttttcctagaaacaaaaattatttccataaagttccatatgcataaacagtgaaaacagaacgtggggtagttttgtttaaatgaagtcttggtgagaatcatattctgtagtacaaggaggctcttaaagtttattctcaatacctgatataattttcctgaactattatggagttttgttatgtatagttggtttttctgacttgatataataactttactagtctctcaaatacaatttggatataaatcattataataagatgattgattttttagactaactttattttttgatatttttaaactattatgaaaaactattatgaaactattatgatatttttaaactattatgaaaagtatattctagtttgaataattccagaatcaaatcataataagcagaagttcttctcctctccctcctatcgttctccttctcctgtttttcttttttgatatgatagttgatctactttgctgctctgttgcatagagtacgtaacagtggcaatgtatggctcctgaatttatcgttcttgcttcatcatcctgctttgaccccactttctcctccaaaatgcgtgttgagttagtttgatcatttggaggtaatttgtttggaacagtatcagactttatagatatctcccatggcttgtgatagaatataagggcaatgcaaatgtagagttttttgctcactcttcgatgtatggttagacaatgtaccactgtaatatatttggcttaggctatttcataaataaaattttattataaaatattataaatgctgataaagctactccagaattttaatagatatgtgggtttcccggccagatgcggtggctcatgcctgtaaccccagcactttgggaggccgaggtgggtggatcacctgaagtcaggagttcgagaccagcctggccaacatggcgaaaccccatctctactaaaaatacaaaaattagctgggtatggtgacctgcgcctgtaatcctagctacttgggaggctgaggtgggagaatcgcttgaacccaggaggcagaggttgcagtgagccgaggtggcgccactgcactccagcctgggtgacaaagtgagacttcatctcaaaacaaataaataaataaataaaaatacatgggtttacattttacccatcagctatggtaggtaaataataagctttgattaagtctattttagtctatttttagcagattactttgaaaaataaagaataacccaatgactaaaaaattattttatgtcagggatttaataaaacatatctttaaatctagttgagggcaaaaatacgtctattttctactatacaatttgtatttatatctgctgtattatataatgaaaatttatctctatttctaatctcaagaaactgcaagcttctgaatcattaaagggaagattcaccatgtgtcctaactatatttactatggaagcatggaaaataaatattttatgtttagatttctgatctctctttcaaaagcagttggaaattatgctgagaaaatgtcttagcttatcccatgttactcaagaaaatgtatttattcgtttttgtccagtggcttaaccaaaccacagtttatttgttgctcacataaagtccagtgtcgatcaggctactcttttccatctttgagctaaggcacatattacacataactttcagtgtacccgaggtagaaaaagagagagcttgggaataaggcaggggctttttactgtctcaaccccaaagtgataaactacatttattctcaaaatccagataaaactcccatagagcctctgaaaacctcaacatttgcgtcttaactataataaggttaactaagattccaaaattattttaaaacagagacagtttccctcttccctggcagctaatattgtattttctataaatccacttgcccaaggtttaaactacattttatggattgaaatgacatttatagccaactcctgatttttagttagatggttggataatgatcttttgatgaaagactcggagatgtcatggtaaaacggtgaactactgaaactattgattattgttaatggcacatttcagctgattgaattgagtcaagaaactggtgttgaagagcaacaaatggaaatgccgagcttgaaaataaataaagcagcataccttaagagattacatgcaatttcagtatttcagctaaatggaagtgtttgctttttttcctctatgaatttttattttgaacaaaaggaattttctataatatgtaggtaggagaaaagtgaaatggcatgctttttcacttcatttgaagaagctggtagcattgtattcatagattcatgctgtatagcaatcatagttctcatatattaaaaaaaaaggaaatttgaaatgcctagccaaagcaacagctctgccaacagattttgatatatctgtctaccccaaaagtagtgatgatttacttcatacaaatgctagtgaatgaagagagagggtgaaaaccttcacaaaatgtgtttttctctaagactgtcaatccgtttttctatatatggagactccagctcttgctagactacctatcactttcgtctatcagccacttcgtaagatatttattctctcagcaataatcataattcatagattctttaaacatacatgtaatataaagcatatacattctgaatggaattaacatgattaattcttctctgaaagacattagaatttcctcccgtattataaaaaggtgtaactcactttccttactaaaatcaagaactttaccgtcgtccttgtacttcaggataagggggtgtttcttataaatattgttatttctgatatgctaactggaatttttaagcaaatgtatttttatagaacgccatacaaagcctttaggggtgaaagtttcaggatttttaaattgcagatttatcctttaaataaaaaaactatattcgtaattgaatcggattatttctctatccaaaacattttctgctttgggcctaagaagagttgacaaagctgttcatggttcaaagtactaccataaaaccctgggtaactaactgaaaatggaaagactctgtctttctgaatatttcacaagagtttcacaaatattaagtggttctctaagtacccctgagagatcattgtaatattagcttgtaaagacaatgtgggggtgtgggtatgtggtgacctttatgatgttcataaaggtggtgtaattaacatatttttctcagcaagacaaactaaggagcaataaatatatgagataccttcatctgtgatctgggtcatgtctcaggccatatctttcaaatcactcccttccctaatctcgtgttttacctacgtctcctctcaatccccccattataaaaattgtcttctgatgaataaaacatttccagagagacaagtttcataaagtttgaattgtacatctgagtacacctatgaattaagatatctttgatttctaatatgttattaaaattgggtgtggtggctcacgcctgtaatcccagcactttgggaggcagaggcgggcggatcacgaggtcaagagatcgagaccatcctggccacaaggtgaaacccccgtctctactaaaaatacaaaaattagccgggtgtggtggagtacgcctgtagtcccagctactcaggaggctgaggcaggagaattgcttgaacccaggaggtggaggttgcagtgagccgagatggcgccactgcactccagcctggtgaaagagcagactctgtctcaaaaaaataaattaaaataaaataaaataaaattggagaagtttctcaccaaaattttggcgcacggattaattctgaagaaagaagaaagaatgcaatcttagtagcacaattagtaccttgaataaattggagtatcgtatttcttggactatctgagaatgcagaggcaatttaaggatccctaattctaaggagaagaaacctttagtgtattccttcctgttgctttagtttgaattgagttttatatgtattttttaatctttctattttgattgttgtctaaagagtgtgaaagtgaattttgatatttttattttgcctggcgatgaatgccttctgctctggatatttaaaaattatatacacatatatgtgtgtgtgtgtgtgtgtgtgtgtgtgtatatatatatatatatatatatatatatataaaatttttctgagaacttttattaattcagcgtatctttgctaaacacctgccatgtgtcgtggtgttaggtctggtgatacaaacatgttcagagagatgattttctttcttttttggggggtgggtaagggaaagaaggcttatacaacagaatcttatttctcacagttctggaggctgggattccaagatcagggcctggtgagggcccctcttcctggtttgcagatggcttccttctctctgtgtcctaacatagcaaagagagacagagctctgatgacacttcctcttgttataagggaactaattccatcataagggccccaagaaaggtgcttttcaaaaacagttcagtaaaagtactgggttgtataatcactttaatgagtatcaatccatatttttaagatagaaatgaatgaaattagtaaaatagaatagaaataaggagtccatcacttttaagtaagtttcaatattgttcgtaaaactttggttcggtggtttgtgtgtgtgtgtatttgtgtgtgtgtgtgtgtgtgtctgtcggtgtggaaatactggatcactttgtaacatatattcaaaagcctctgtattttaacattatttctgcctttgagaggttcacattccagaggtgaagacatacatcctaagacaaaattataatagcattatgagaattacagtagagagctggacagggtctagcaaaaacagaagactaggctaaaccttccaaagaggccaggaaactcacctagaacggtggattttaaccttgcttatgcactgggggagattttaaaaatatctctgcccacaatagataccaactgaattgagcatagcatgtcctacccatgaatctattgtccagtgagaacctctgtttagagaaagtcaccttagaagaattgttaggagttatttaggttcatggggttgaaaagagcattcgtgatagaggaaacaccatatccaaaggcttagtcagtgtggtagtgtgagaatctgaaggaacttggctggggtatggttgctacaagaaatgaaattagatcaactggggctaaattatgtggaaagacagcatgatgtagcagctagagtatggaccttgtaagcaggaagaccccttatttagcacttactagcttattgtctgacctctgagtcccaattttactcttctatacaatgagtacatcacaggattttatcaggtttaaatgataagatatatgtaaaatgcataccagagaggcagactattggactcgaagggctcagtaagtgtaagctggctctctctgccccttgccacctatttttcagactctggacttttatcactttaagtcatagcctagttctaagcaaggaaatggactaatcagacatgtttttaaaagatcattctggtagtggttaggagaatgaattggaaagatatgagacccatgcagggacaacagttaggacattatttctgtaataagccaagcaagaattgatgatcaaagtggtgaggttgaacaaacaaaacagatacgtgagctatttggagataaaatcaacactgtcatatgttttgtgggaggtggaggtgagcagaaaatgtgaggtaaaatgagaaatcagtgcctgcttaccacttggcatgattgactgaaggtagtgtcttcactcaatcatgagttgcagaattcaagatggcaaacagttgtgaggagcaaagtcaagaacgtgtttgattttgaggtatctgtaagtgaaaaatcagaggtgaaaaccttacctctcttgaagcagttgtgaatgtaaatctaaggtttggaaaaagatctgggttaaagatttaaaattgaaggacatcaacatggaagccatagaaataaattatattacacacaaatttatgtcgttatttgaatttctccatggtccactcagaaatatatctaaatgtcaccaaaatgttacttactgtagtacagaattggtattaagtgatactattgtccatgttattcaaaaagacagttatagggaccctcttaataaactaattgtgaaaaaggcaaagaattagcaaagctttggcataaaattcatatcatgggccaggcgtggtggctcatgcatataatcccagcactttgggaggctgaggtgggcagatcacctgaggtcgggagttcgagaccagcctgaccaacatggcgaaaccccgtctctactaaaaatacaaaaattagccaggtgtggtggcacacgcctgtaatcccaactactcgggaggcagaggcaggagaatcgcttgaacgtaggaggcagaggatgcagtgagctgagatcgtgccattgcactccagcctgggtgacacagtgagactccatctcaaaaaaaaaaaaaaaaaattatgtcatggaaaaagtaaaagtctttgcataatgtatccaagatcatgaaaaactcttttcaataagataattagttccttttcttatataaacatggaaattttcatttttccttttattctcatattgatactataaaaaccccatcctcattcacaatactactgtctctaccctcgatagataccagttcaattgaacgtagcatgttctacccatgaatctattgttcagtgagaacctctgactataatgctcaggaatactcaagactcacatgattgtcttcttgctatatttagttactttattattttccattttgggaccctgaattcctgtagatctcagagaaaatccgaaatgaaataatgaaaataattaaaagtttagaaaagggagtcaatggggacaaatgttcaggactggtcttttatctcctgcaggaagaaagactgaatgcagaaaattagaatccatttttcatccagtcaccccaatttaatgcaatatgagtttagctatttgattttaagtgttgtaccgttttggaccatgttaccatggtaacatgaaccatgtctcattcatacgtaaacatgttaattgtattaaaacctttaaaacctacttctggatgttgccattacattaaacaattatctagaatgatacaaagtaatgactaaattgaataactttgtaaattaactattggattttgtaattttatatctataaaccaaaagaaaagcccacattggtaagaagacactgtgcatactgaaaagtcaattttgttagcctccaataaccattgtgttttattcctcgcagagcttttgtgaggatcttataagggaataaatatgaaagcactttgaaaaagctttcaagtgaaaggtccttattaattttatgaattaccattaaacaaaagtcaaactgaagatgtaaatctaataggatgctcttaaaagtcaatggatcaaagttatattaattaataaagaataataactaaatattttatgtttcataattggcaaagtatctttactgtcattttctaatttgatccttagtgaaaacctgtgatgttggtactcctattatttccattttcatttgagaagaataaaattggagaggttaagtaatttatctattgctacttgttaaaataactactaaattttattactcccagttaggagggcaattatataaactaaaagcttgtcacaataaatgtttacttttctgggattaaagtcatcatgtatttttcaattattaaggggggtaataataataatagctacctttttaaaatagttactatgtgccaaggtgtgtactaagtgctttgcttgcatgatgtaataccatcgtatatttagtacagaggaaaaactgagaggctgggtaacttctactaaggtaacacacaagtactggttgagtatcccttatccaaaacacttgggaccacaagtgttatggatatcaatttttttctgattctttttttggatttcagattttttcagattttggattacttgctttataattatgggttaagcatcccaaaccccaaaattcaaaattggaaatactccaatgagcatttactttgagaatcatgtcggcgctcaaaaattttcagcttttagagttttttggattttggattttcagatttgggatgctcaacccgaatatatagaaaagtcagcatttgaacctaagtttgactttctgatcttctaccaactctactgtcctacccattactctacattgactcagcattacagggaaagacccaagatcaccaaaagcaagcttcaaatcactcatctaatagaaattagtggaaatatttctacttcctaaacatccatctttcctttacattttaaagtcaagtttctacatctgcctcccaactgaaacacttctctatgaaatcaccataactaccaaatgcaaatatttttatcaagtcctcattgccctagaaatctactcatattttgttattactgctcactacagcctactgaaaaatgtctcaccttttgacttgccagggtgatatattatactaattgtctccttgtctctctaagcactcattccttcctctttctttcttctttttttttttttcacttttattttaagctctaggggcacatgtgcaggtttgttacatgggtaaattgcatgtcatgggagtttggtgaacagattattttgtcacccagataataagcatggtacctgataggtagtttctcagtcttcaccatcctcccaccctccaccctagagtagatcctggtttctgttgttcccttctttgtgttcatatgtactcagtgtttagctccacttataagtgagaatatatggtatttggttttctgttcctatgttatttcacctaggataatggcctccagctccatccatgttgctgcaaagaacataatctcattcttttttctggctgcacagtattccctggtgtatatgtaccacattttctatatctgatctaccattgatgggcatttaggttgattccatgtctttggtattgggaatagtgcagcaatgaacatacagctgcatgtgtctttatggtagaatgatttatattcctttgggtatatacccagtaatggcattgctgggttgaacggtagttcagttttgagttcttagaggtatttccaaactgctttccacagtggctgaactaatttacattcccaccaacagggtataagcattcccctttcttcacaacctcaccagcatctggtattttttgactttttttttttttttttttttttttttgagacgaagtctcgctcttgtcccccaggctggagtgcaatggcgcaatcttggctcactgcaacctccacctcccgggttcaagtgattctcctgcctcagcctcccaagtagctgggattagaggcgccttccaccatgcctggctaattttttatttttagtacagacagggtttcaccaggttggccaggctggtcgcaaactcctgacctcaggtgatgcgcccgccccggcctcccaaaacgctgagattacaggtgtgagccaccacaccaagcccacagtatcaattctatgcattcttttctgatttcattaatctcattatcttcatttgatatttagtcaatagttactgtcagttatgtgttagttattatactagaaacagtcttttctccatctcctttaatccaatgatttgaacatttttattcctttccaatgtctgtcccacatttcttactgtatgtaggacatttcttactcaaatgtctcacaaatgacataaattcagtatgacccaaataggccattttttataccaagtcttatttcctatcctgctgttcatcccggtaccatcttttcagtcagagagttcagatcatatagtcatttctaaatctcccacttacttgcctcactttcaagttcatttttaaggtctgtagattctgcctccctaattctttatgaccattcctttctcactagccccttacctccactctcattcacactcttactattttttaccctcctccactcattcctgcccaccagtggctccaatccaacttgcagatttccatttaaattaagcttcctaaaacatagcttaggttgtaactacaatgcaaattccatgagagcaaagatttcatctgctttattcacttgtatatatccattgtccaagactgtgtgtgtcacatgaaaagtgttcaataagtatttgtcagtgaacgaaaataatatatgactcccctcttcaaacaccttttttgacttcaaagcccttcagaatattctacagactccttcacctggctctccacaattgcccctgagtctcgtttccaatcttatttcttattttacctctcaatgcaccttcaactcctactaaaatgaacagctagccagcttacttctgtgtctttcgatgatcttgttttttgtcttgagattcctttttttcatctaagcttacccaaacattacctacttttcaaggaaagccattttcgaatcttccctttttccctgagcccccaagctggaagacatcttgtctccatctcaattcctataggcatttctctgcactttaaatgacgtttagtacttctgacattgcattagagagaggctggggtggatagtgtttcatagtgtgaactttgaagcccgactgcctgagtttaaatcgtgattctggggcttactgaccatagacgcatttctgaattgctctcagattatggagcataaatcaaaagtaatgacagctacctcttcaggttgttgtgagggtgatgcgaattaatgtactgaagtgcatggaacagtttctggcacacggtaagcacccaataaacatagctaatattatgttattactattttcaggcttatttttatgtatacatatagtatgtaattttatgtcaatatgtataaatagactttggtattgtttatttcactatcaccttgagagcacaattctcatttgatttgtgtgagaaactacttagaaagaaatagacgtgtgaatgaaactatgcttgaaatattggttactgtgagtgttgaaaatccattttgtttaaagaaagcttcaattgttaatcttccataaattttagttcttaagcgttcatattgactcgttttggaaaagctctttaaagtcttgggatataaacaaggctgaataccctcattcatgataacaaacatattatactgaaaattgtaagagagatattttatctttcataatgccctccttgggaaaatacattgacttggcccttctctttcaatcagacaccaaagttgagattgcctgaaacacagtttggtaaaaggagtttctttttcccaaacatcctgagtaacacaggaaatcacaccaatgactgatagataacgttaataaaattaataaagttgttttaaatgcataccatggggcagtggcaatgaaaacattgagaaggctgggactatttgccaactttctttgatctccattagaacctggacaagatccacataatttcagaacttcttctccaaacaagaattgaaaaggtcaggaaaagtttgaccacagaaaaatgtcaaagaattttgtgtcactttctcctcctcccttcctctaaccttgaataattttttagggttattggtctttgggagcagactttctagaccaaaacaaaaaaaatgatattcctctatgtgataggtaacaatcactacccatcctactggaaaattctcaaagtgtaaattgaggggataaaaaaagaatcttaagtcctttaaattatttttaagatgaactacattagtgcctctcttgtgcctttcataattctgataataaaacattccaggtattagtcaaagattaatggtattgaaaataatttaggttatcagcatgtgattttcattccacatgaggtccttttgcagtttacatggttttctaaattatattaaaataaaatgtcagaaagttcacatttttttcatgtttaacagcatcaatctttaaagaaaagttattgcacaaaggtctgtgcataaatcagccattctccgaagaggtaaaagaagtcattacgcctggttatgagagagagtttcatgaatgtaagagacataaatcatttcccactggagatcatattagtctagatggaagaatgtctgtttcttgatagtgagaaagcaacaaattacttttgtttgctcctgagtctgtggttgtccttgagaggtctgttagcatgttgactattgactattcaatattagcattataataacttacaatgatctgagtcacataaatataatctttcagttctctaaagattttactttttcctctctaatatctattcacctccaacacctttgcaaatatattattctctgggagttacaaagaaagttattctctgcaggaagcagcatttcagttgctctcaggagccaaccacatttcacctcaattctttgctcccaattcaacaattcaatattggattaaattcaaggctgtgaccccaaatagaatgagacctggatatttatgaaccacttgaccaggcattcttcccatgatttactccataaatcctttttagtttttgcagtagctttacaaatatttggaaaatggctgtgcaatgcagttttaaaaagtgcaatgagtagaggtagcttcttcacctggtatggtaaattgttgattctcttttggagtggaaaacaagtgttcttatttggatgcaaccattgcattgattagacaaccctaaattcatctttcatccatgacctgaaagaaattttgaaattcatgcaatatatacccgtagtggaaaatgtactttttgaatggattcctgaatgtgacttttaagaagagctattaagaagtgggatcttctacagaacagtaaacaggcatgaaaatatacaagttgataagatatggaactaccccaaaagaggaattaatagtggtggggcttggggcaggaggacagagagacctagccaaggaaggaagggctatattataatagagtacaaagtcctttagtcatccaagagaaggggcaccttctgcatcccttatgagtaagatcagagaaggtattctagttaacttttgctacataacaagccagcccaaaacttcatggcttcagtaaaaattacttgttttgttcatgaatctacagtttgctcaaggttcaatggggcttgcttatccctgtttcagttgatatcagttggggtagattgcctgatgctggaggattcacttccaagagggctcactcacatgcctggaaaataggtgctgactgtcagtttttcttcatgtggacctctccatggagcagtttgggctttttcacagtgtaagagttgggtcccaagagcaattatcctaagggacaagaaattaaagctgcaagcttctcaaggcctgccctaaaagcaagaatggttttgcttctcccatattctatttgtcaatcagtgacagagctctgattcaaggggatgagaacataaactccacctttccatggagaagtatcaaaaagttttgatgccatttaattaaagctgccatacaaagtttcttataaatgacactgagctgaatgaatactaaacagcaagtagtcattatcccagtcaagagaagttatctttgctcagaataccctttctctccttgtctacctggaaaattcaactcttggccaaagccctacctcttctcgaaagcattaccaggccttgcctctaagtgtacaattggagatacaccagtatactgatgtttttaaaactttaaacttttttctacaataaaacataaattaaataacttcccttctgacttaaaagctgcaaaatgctcatgacagtaactatataaattaaaattaaatcttaagcacgataaatacctctcgaatagcaacatagatgcttacttctttatttcacttctttatttgcttttctttgtctatagtttgccccaaaggtattttaataatatcgggttccatgtataccagtgtgtaccaattaatatttagaatatacctgttaataacctcatttgcatagccctactaatctgagcacagcgcagccttaagaaagtcttagtttttctcagtttagttcatctctcttctcttctcctcctgtctctcttatttcctatttctttttcttttcaagtgactttcaactaagtagaaaatgcatttcacatcactatgccggcctccaggctctgtctatttcattcacccaggaatgccctttctgaatgctttctctcatttagcagctatctattgaagttggacaaatgatagaaattcatttcttaaagagccagaacatcatcttgaacaagaagttaaaagaattcagcaaatcaaaagatgagctaatatgggtgaatcttagaggcattatgctaagtgaaataaaccagacacaaaatgaaaaatattgtatgattccactggtatgagctacctacaacagtcaaatttatacagacgtaaagttgaaggatgttaccaggagctggaggaagaagagaatgagggcttattgtttaatgagtacctgagtttcagtttgggatgatgaaaacattctagagatggatagtggtgatggttcaacgataataataatataatattaatgtacttaatagtactcaactgtatacttaaaaatggtcaagaaaatggtaccccgttatcctgatgtgattattacacattgtaggcctatatcaaaatatctcatgtaccccgtaaatatatgcacctactatgtacccataaaaaaaatttaaaggctaaatggccaggcattgtgggtcacttctgtaatcccagaactgtgggaggctaaagcaggaggatcacttgagctcaggagttcaagaccagcctgggcaacatggcaaggccccatctctacaaagaattcaaaaattaactgggtgtgggagctcatgcttgtagtcccagacacactggaggctgaggcaggaggattccttgaacccaggaactggaggaagcagtgaatgacactgtaccccagcatggtcaagatcccaaatcaaaaagaaatgattaaaatgatcaattttatgttgtgtatattttgccacaatacaaaaatggggaaaagcctattcgcttttaagtatccttaaaaaggcacagcttcttcagctaacagactctaaaactttttttaatagaagtattaaggtatttagagagtgcaaaatatcttattttaagtcaagaagttagggtcctgttcctaaacactagcctctgtaatcctggggaagtcagtgctgttggagatctcaggttgatcttctgaaaaatgatggatctaggtaaaagatatgtttctccaggtttacataccacggacaccatctttacttggaaactttattaaaaatgcattgtgtcagaagctctctggggatgggtcgtggaatctgcatatgtaaagagcccctaggtagttcttgtgcccacttaaatttgagaaccactagaccagatgttttgcttatggccctttcagctctgaaatttgaaaaaaaaaaaaatgattctgcaagacagagtctctgtgcttttgcaggataaagaaatgaagaaaataatacttcctgcttgtgttggagcatttttttcatttggtatccccatctccagtggctagccaatcaagaatagtattgtttattcttcccactgttttgaagatacaaaaggaaaagctaagccagatgacacctaaaggcttccattaccattttcatgtttttccctttgcataaaaactgtccatgcctccatcagagccatgatcactagtacaatgttacactctaatgactcatgacattaaattatatcttagcctaatatgaccaaattacaatatcagaataaaaatttcttttttcaggttgaatcccataacttaatccaattataatactggctgaatttttcacaattatgtctcagtcttgatttagggaatcttctctttatcataaaaatgcattttgttaaacatgtttcattataatcaatttctcaaaagtaaagttaatcaagagaaggaaaaaaggttttgttttgatttgatttggaatgtgtatgtgtgtttactgtattgaaatagattctgtctgaaagactgtatataagataaaaagtacagaagagtagtcagagagttattacccacccctgactgatggtgaatagattatctaagtatcccgtaaaaggcacaactccttcaggtatattttacaaattaattagtaactttctagccaaatttgtgtcttaaagacaccagctagaacttggttagttctagcaaagaagattattttattctgaaacaggtttttgttgtcgttttacttatttgaacttttttcttgaatatgtatttctttgcacataaaatatattgacttatgaatgtgattaaaatggaaaataattagttgattttagagagacagagagaggagaagagaagtgtgaaggagagagggaggatagaaaggagagagggagaacaggaaggacagagggagaatgggaaggagagggagagagagagacagagagagaggaatggagtgggtaataagcaagagaaaaatgccaatcatatgctttgctagtgtgtaaagtctgataacccaagggagagaggactactctggcctagtgaaacaaaggaaagagaaatatggtagaatattctcctggtgcttcaccaaatgtgacaccagaagtctgacagaagtcatgtcagcatttgagctccataaaactcaggctatcgacctaccatgtgagagtctcaaaatgagtttaggtaggggcagaggagttgaaatccagtaacatatgcaacagtgatcacaccaggattgcacatagaaagcaaattagtcctctaatagagacgccaatttgaaattcaccctctgagcaggtttttaagcacactcttcttttacttttctatttacaaaaatggaacaccaccagaaaaacaagaatttgaaagacgagatgagaaaagtaagttgtaattggaaacagacagaatgtgtacacaaacacacacacacacgcacacacacgtgcatgcacaggtgatgagagagtagtttgcctacatggtgtatctgactaagaagactttttgctctggttgtcttacaggaagtgactaaatctcatgatgtgaaatattttcttgcatattgtattggaaaagaaaataattttcccaaactccttaggggcagtgttgtcttataattcccatatagtatatgctcttcaagtaagtaactccagagttgagtaagacaagactcgtgactcagatggcatgctctgctccctagactagacattgcatcagtctgcctatactcacatccgctgttaaaggattgcctccagtaaaatatgtcttttaattccttatacaagaatctggaaaaaaaaagtaagattctctatttcttaaatttagcagcaggttaatcactgataacaataaaaatacataacaatcatctagcacgggtaaatattgtggcaaaaattacaccctgaagaattcagtcaaagatataagtaagtacacatcattgtcatgttccacaatatatcatctgctttaaagaaactgttatgtagctgtagtagatttaatcattaatcccatttcttctccaccttctgcaatcacaaccttaacaatgcctccttatgagtggaatgtacttcccaacccctagtcttaggggttggccatgtgatttgctttagcaaatggtaaatgagcaggagtgagaggtgacagttttcagcctaggccttaagagatctatacattcctgtttgtgcttctgctatcattctgagaacacgtccatctaggctgctggtctcaggaaaacgataaaagacatgaacagcagggctgcactagccattcacatccaggaaaagaaatgattgttgcataaagccattgagctttattctacattactgtgacaatagctaattgaaatagtaaatatactttggtttttcctaaatgcatattgaaaattaataatattagccatctgtatgataaaaatataaagcctatgttttattttttaatggttcactgccctaaataaatttccaaaaagtagatgttcccttgtctagtgatgtcattatattttatttatacatcataaacacactgtttatttctgctcatttttttgtaagtaacatgtgttaccgccaatcttgagatgatacacacacttctgtactaaattttggaaaacatattagctacccactccttatatcaaaatattgcctaataatgtgttttgttttaatccttcatgaatttccaggagaactgaactgatacttgggtttgtgagatatatgaaaatagtgaacatgaacttctggtttaacccttgtgatgataatggaatcatagctctgttaattactcttgtggtttgtcttcctagagataatcatgtacaaaattcctttccaatttgttatataatattagaaatacttccaaaattggcatggatttattgttatcatttgttggcacaatcattaaaacgaaacccataaagctagataattaaatgtttacaaagctatagtactcaaaacaaaaacactgtgaaaagagattttttaaataatagtttttgcatgccttttgaataattggattattctgaatttcttcatgtttagtccctgaatctaagtcataccgtctacataaaaatagatgtcagctgaagaaaaccaggcaatggatttgtcttgacgacaatctttttatatgttcagacttcatttaacattagacttgtctgtatttgaaattggtatttctttacatttctgaatttagggaaatggcacaagagaataacattaatttcctctgcattttggcctaatcaaatttgagcctttcaagagacacagccaagtcaattcaaagagacatatgaaaagactactgttaatgtatctttaaaatgaattagcggcatgaactgttgctaggtgagttaggtatagttgtagtttttagtaaccctaagagaagatgcagtgcattctaaaatgtcacaaggagtttgattgctcaaaattctgggagattggctctctgcaaggcttcttgatgtcattgttcctagaggaatgttgttccagtacctatagcgattgcagccataactatttatgtgtcattgtagccattgttattactacatgcttcacatacctctactgaggtctaaagaattagtggacttcatattctggagagaacacttgaagaaccaaacagaagtttgatgtgaatctgcatatccaccattattgttcataggttctcaggattagttgagtgatgccttaaagaaagaaagtcagatgataggtcttcctgctgcccgcaccacatcatgagtgttattcctatagaggaggagtaaagagtgggaagaaaatgaaatctgtcaatactgtgaatatataaataataaaagtagcagtaggactgattaattctgaatcatctttatgaaatgactggagccgtgaaaatgctcagtctgcacagctgattgagaaatgtatgcaatctgttgatcggaatttatttgtgaatgctctcttccagagatttatataccagagttcttaaaacgaattttgtccccatgaaaagaaaactacagatctgtaagactgcaatttaaaatggaagaaaacatgttcccacttgaagaacaactttcaaacaaacaactgatacaaaaaagtcaaaagctgttttgttttatataatagtttcagaatacttccagtcaatatataccttggtttggtgaaaaaataaaaagctaaatccttagatcattaactagaaatttttgtaaaataaataaaagccgtgggttttagtgcagtgatcccatgaagaggaatatattcaccattggtctcttaatctcagatagaatgtacatgttactttattttataacgaaagcaactgtgttgtgatattatgtataatattataacaggagaagtcctcttagctaactcagtaatcaataacattgtacgttgtgtgttattgtaaccaaaaactatgacagaaccccatttcataagatcagtttatccacctatatgatttatatttgaatattcatttcagtacttatgttgcttaaacaaagctactgtattagtccattttcatactgctataaagaactgcccgagactgggtaatttctaaaggaaagaggtttaattgactcacagttccacatggctgggtaggcctcaggaaacttacaatcatggcagaaggtgaaggggaagcaagcatcttcttcacaaggccgcaggaaggagaagcgcccagcgaagtaggaagagccccttataaaaccatcagatcccgctatcatgagaacagcatgggagaaactgcccttatgattccattacctccacctggtctctcccttgacacgtggggattatggaggttatggggattacaatttaagatgagattgtggggtggggacacagccaagccataccaaaaactctgttttttgtttttgtttaatggaaatgatttagaactttattttctgatgtttctttttcataaaaccacgacaccaaaatctacttttcactgctccattcaactagtagagaatatctaatctcttctcaagtatttctttctcaattatggtggttttagctaagaacagcttatggcatgcttttctaaataatattagaacacataaattatctgtacctggtattaccacattcattgctcattttaagatctcaattgatacattcaattcatatatatttaaaattgattcatttagagcaagagatacaggcattttaatgtattacactgctactaaagcttagcaaattattcttttttgtgcccacaaattatcatccattcatgtcctaaaaataaaattgaatttattatactttcccatttatccaaaaaaaaggttttttttaacaattgatgcagatacacattttcaagctaaaaatatgtgtgaaagtggcctctttctcatagtatttattttaggagtctagcaataatttttcttaggttatcagcacatgtcttagcctgaattatttgaattcagtctgtgtcttcaagttcagatggttatgtgatcttgttaagatctcaaagtagtgggaatgatggagtatacaacaacctcattgttttttatggcaactgtcatttactgaaggacataaggctagcagaacatggtcagagaaggaatcaaagtttggtcagccaactctgctccacagctacaagctgctagacaggcataaatttttccaaacctacacaaagggacttagggcccttggctgagagcgacattctaaccacttccttatttatggctggtggggtttgtacattttctcatttctgtataacatttcttgactgtaataagcaatgtattcattctgctttaccactttcactaaccttaacctcaatatatactcaattaagcaattgaaaacagcagttttaatcttttgacataaatgatttcctccgaagcaaaatgctggaaatcccctcaaatgcaccttttattgatgaatacctataagcaccacctacagtcgctggaggctgacaggaaccaaacttgatgataaccactgagctgagaattttcaactcactctttttccctgtatggttcttctagctgcattatttcccactatttaaagctacagctggtgaactattcaaatatttaaactttggagaagaaaatatcaacttatcacaaccctctttttatattctaaattcatatacctgtttggtacttaaaggaaaaatatgctgaggaacaggctggtcataagactgtatagaacgtgcatcttccatcctattgaggtgactcctagacaatgggaaaaatgccttcactcgacttgctcattaaatgtgaccgtagctgctaatcttttggcgctgtctcgaactttaattagatgtgctcttctcttgaaggttggaactacagtatccagagaccatagaatcacagagttgaaaacaaaatcttggaaatcattgaatccacttatcagatgagaaaaaaaaaataagcccatggagatagccattttaaaacatatcattctatttagcctccaatgtaaaacaatgagttactatgtttcaataatgttgatgttaagaaattatttgatagcttcctcacttggtctcctatattcctccaaggttactagttaggaagactgtcattcaaatttggagactacataagaagcagaaaaagcatataaagaggcacatgaaattggaacttttctggtaaaatcttctttcttaaactctcctcaaataagctgttggtggcaggaggtgaaagacagcctccaccctttagcacagtccgtacttgtcagcatttcccaggaagggtgatgtctggaaatgatagagattgtggaagcacattgcattatgggtcaagaatgcgaaggtcaaggagtggagtcttcctttacgaagtagtgttaactgcttggcgtggcattgttgtaaacagaagccaccaggaaggatcatccttaggagggaacctgtagatatgactgaaaacaagagagatccagttttaccactctggaaacataggtaatagaaagcccaaaaggtaccttatcacttgtttgttcctttctgtacaaaaggacttaaatcctttctgagcaagaaagatatttgagaatccaattttgttttaaacttgagcttagcattttggaactattccaaagaccacagaattcacagtcattagcataccacagcagactcttttcaaatattgcaaaccagaacagtctgcttgaaaacctggaaatacgacctagtgggttcaacttgactttttttatttctaacccttacccctaggcaattattgataactcattctggtacctggtatgtatatggactttgttagaagaatttgacaactttctaatcatctgttttttttcttttgcttgatagacatacatttagtagaactttactggattgtattgattataaaccacatttcagttcatatcagtccattttgctgcacaataaacaaccaaaaaaatttaattcagtggctaataacaacaatattgatttattcatggagctgcagtttggtagggtttggccaatcatggctggaaatggtttagctatgcttatctctaggccgtcggttctgttcgggtctataccacatattttcttctgagactcaagctgaagggacatcagctactcggggtatgacagagtagcacaaggcaatgacagaagcacaaacaacacttttcaaaatctctcctcttgtcacatttgtttatagcccattagacaaaacatgtcttgtggccaagcccaaagtcaaggggtaggaaaatactttccacctatgtgaggccatggctggagcgtgaatgtatgatactactagggatgtgaaaggattgaggccaataattcaatcttctattggagacaagctcaacgagttagttaaaatggaaggctaatatttactaactttgcaacccaaggaagagaaagcaggatctctctgacgatgacggaatttcataccctcatctttgaagttatactaaagcttaggaacaaccgtcagataggactgaattgctcccccttccagattcagcatgtgaagtatgcagcatcttattatagcagtagccaaaacagccgttttcttcaatttgggaatacaatgtaggtgtgttaattttcaattaagagttctaaacttattatctgcttggtagctcttccatgtgacagtcattccatctgactcttcatgttggcttttgaactaaattttaaaggaaccgccaaaatttaagggccatgtactttttataacctgtttgtggtctgggtaagaaaataaaaattatacaactgttctttttgaccagccacaagcatgtaatgaaaatgactgttttggctagcagatgtattagaagctttcaaggtgtttaaaaaaaaaaaaaaaaactggagaaaggagccagtgaattgacctcaaacaaaacaagaacaaataaacaaaacacttgtctgcacttccaaggaagggtgatatctagaaaagatagagatgatggaagcaccttgcattatgggtcacaaacgtgaaggtcaaggggtggcgtcttcctttatgaagtagtattaactgcttggcagggcattgttgtaaaaagaatccaccagaagtgaaacaagcagcactaaaagttaaaagatttatgtgtaaacctcatctaaggcaacagaagccatttctataaaatagtataggaccttttattatatatggtcctagagtatattaaaataagtctgtttgggtccatttgcagctcatttgaagatttttataggaaaaacatcctcaaaaatatcatactacagtgccttgatgcttttttctttttataaggtactgccagcccaaatagtaagaaaccgatatgatttttgtccatgtgaggtgtttaattgcttcccaaaatatggttattgtgtagatgtcactaacgaaatatataaagagcagtatttgggaaaatttattttaataccacctttttccttttttaccctaaaagtatttatttttttcgtagcatacactctgtgtctcagtatcattgtttttcataaaaacataaattcttaacagaaaatttcctgcaagctcccctaagcttgaagagacaaaggagatttgtaatgtagctcagccccaatcagggtaaaagaatgcagggctgactttatacttataactcagaaaaaggttatgcttcccgtctcttcacagagctagtctcttaattgattccgaactaggaacatgtacaagtggcccacgatctggaacagactggcggataatggaatattgagaccttgtctatggtcagccatattaacactggataagtctgataacactgtgattacatatgtatcaatatagtatgctgttaatatattaaaaacttatttacaacatgattattggacaactgttacagtacagccacatcaatcctatatcaagttagaccatgtcaactggttttgtgttgagacacctgtgtatggacatagtctgaacttttcatagtttgtgctaaatgatagcaatcaacatcggtatggcacttacagtttactgataactttcatgcccattaacatagtaccgcaataactctgtgaagtgctgaatttgtgtcctgtttcatgattgtatttgtgttgatatctcagtcagtcagagtcccaacaagaaacagatggcacattcagattagggtaagttgaggagtctttatttacaaggcactacatactcaggattgggcagggtgtagggaaatctcacaagatagcacaagactctaggactagcagcagcagagctgtcacctctcctagacctgaagccgttgttggggagagaggtttctcagagcccagaaaaaaagaaaaaaaaaaaaaacatcatgcagattttaatgccttgggaggagcagtggctttctcttaaggacagaatttgcctcgaaatgatactcagggaaaaagagatgaagggaatcaatactctgacccaagactctcccttctctgcagtggtttgctagtcctctccttggtcaaacccaaacagaaaaccatagggcataggagtctaatgatgtaatccaagtcagccccctggaaggtggaaaaagaagggaaaatggatctggatctggagggataccaaaaaaaaaaaaaaaaaaaaaaaaccatagttggcatgcttgtttattgatattttcttgcatgatataagaatccagataaatatagtaagaggtctattttactaacaattttaggcacctaataataatactccttctttgaatgtataacctctagaattggttcagaaatgtaactgtgccgttacaatttctattagtattcaacagtagattcatatccattcatctatgactggagtatctgccatttgctggttagttactgtgtaaggtactttgtaaggtatagaaatacacttggggtgcgatggctcatgcctgtaatcccaaggatttgggaagctgaggcaggcagatcacttgagtccaggagtttgagatcagcctgggcaacatggtgaaaccccatctctacaaaaaatgcaaaaagagtacctgcgcatggtggcatgtgcctgtagtcccagctactcgggagcctgaggtagaaggatcacgtgaacccaggaagtcgaggctgcagtgagccataatggcacaactgcactccagcctggatgacagagtgagaccctatcaaaaaaaaataagaaataaatttgagctcagtgacctacattctagtgcagaaaaaaatgaccatagttgattatgagattttaaagcaataaaccacatgagacatactaatgagctcataagatcattcagaaattgtttattatgaacacatagtactttcagtgtggcattaaacagagatcactgtccttaaacaagttaaaagcagaatcaaatcatctgcaaattaacacaccactaaactttaagcttcttgagtgattctgtaatttttaaaatgtcttcagcatttcagtgtcaagatagtgcaaactcagtaaaagcttgtggaattgcattaaacaaaaccaaaataaatagattttattaaaactatatacaattgtctttctaatcatatcctctccatgaatagggaagaaataattttaggaatttaaatatcttctatcttaatagttcctcttatttccctcttaagcaatgttcactccttcaaaaatatttattgagcatctaatatgtacttaacactgtgccaggtgctgtgaagaatgccaaggaaatagaatgaacttctaattctttggagttccaattaaataacctaaagttaaattggtttcggagagaacattatgccttcgagactgtaggcttctcttgattagaaagtcttaaacattttaagtaactaaacagattaaggagaattcaaggatgcctctcactagtaaatttggattagtctggcaaacttcagaccttaaatgcaagatttttaataattaaaagaagagagaaaatgataattacatttctagagtctatgtttaccattcagccttcttaatcatttcctaagtatatctggtgatcaggattttataactccagaaaatctttctatacatcgcataaatctcttcttttaaaaagctcttcaattttgtattttgttaaaacttaaaagcctccatgaaaaatgagacaaaagtcagtgagaggctgtagcaataaaaatcagatgtgattttcttttgaataacatctgtttttacagtcctttcatgttaaactttataagaatttattataaacagctttattgacagttcaatcctatttctaaaaggatttattttcccccaatggtaagagttttcttttcttaaacctaactagttgcagatatttcagatactacatttctcattgtgtaaggtaaagtttctgaccacctgaatatgacttgtagctcctgagaacaatttgtttagtaccgatatcatgcagtgacattggtacaaaggaattttctttatttcactgtactgttttcagttttattctatagttgttaaataagaccattaaatatttttattagtcttatttcctgtttaactaggtgggtttttgatctctgttcagtaaagcattgtgctcttcagagcaagcaattgaaaagcaaatagtgagtatttctactgtaaaagtttaacattaaaagatatacacacagccaggcaaggtggctcacgactgtaatcccagcaatttgggaggctaaggcaggagaatcgcttgagcccaggagttcgagaccagtctgggaaccatagcaagactccgtctctaccaaaaaaattttttaaaaaatagttggatgtggtggaacacctctgtaatcccagctactcaggacgctgaggcaggaggattgcttgagcctgggaggtcaaggctgcaaggctgcagggagctgtgactatgctactgtactccagtctaggtgacagaatgagaccctctctctctcaattaaaaaaaaaaaaacaagatacacacacatatatttgcgtaggtaactctaatttcatttcaagtatgttatgtaacaaccatttgtgtagtgcttgtaacagtcaatatgtaaatactgactcatcttctttgacaattctacctagatacttattagagtcccccttagtcattgaaaggaaggttaaaatcaaaagacgttgtttgccaaagtaatgaaagaaaacttataaacacaatgtatcatgtctggggctgaactaaaacccttctgatatgtggtattaacagatcatctttcatgacagtaccagttattagaaataaaatgattggagttattattaatactaacaatagtggtattcttaaaatgacttccttatttatcttcacctttatacattctactactgcttcaagacccatcttgaattcttcttccacagaacattctgcattaatttcagccaacattgatttctctttttaaaatttgtcttgcacagtgaattagaaaaccaggaattggaaaaccagaaaagcttattaagtaagaagcagagaggagagagtttcaacaaagggccattctaaagtggtctactgcggacaccatactgattatagttggtgattaaatcttatctttccaactgattataaactcctccagggcatactcttatattccacaagatgcttatctgggtgcagagcatgcatgcagttggtatttgctgatttatcaactaactaaatcttaacatattattattaacaatttaaaataaagttaaatgtatcactctccacccctcaaagccatttctgttctttgttttcatagcaccattattatttcctgcatagtattttttaaaaaccgtatttttaaaatttatatatttgtttatttgggtatacttcactagattgtaagcgtcacaaaagcagaactattataaccccagccactaacacaatgcctaacaaatagtaggttctcaatatttgttgaatgaatgacctacagatattacttcattatgaaagattttgctaagttgttttacatctattttatccaaaactaaagttcttgaggcaaagcctagaatatcttctatgttctcacaatgctctgaatcagtgcttctcttaatatgcatagcaattgcctggagagcttgttaaaacatagattacttagccccaaccccagagatgctgattcagtaggtcccaggtgatgctgctgctgtcagtctctggcgcacactttgagtagtagggctctaggatgttatatgtacagacacatgctgaatagtgggctatgtgcttacttgctggctaaataataaatgttctcactgagtcatagaactttgaaatttgcaaggacttttgctattatctagtctatggatagcaaataacctgataccgtgctatagtgcttgactgcatttaacctgcagaatcctcatgagcagcccagcaccatcactccaagtgaaactactctcttcttgaggttgtccaattctatcaattaaagatgaaaaccaggttctgagagttgaaatctctggacttcaaaggtccaacagcccaggtcttctcaattctcgttagtgtttcagcagctgaatacaaatttattaagctgtatcagagtagtatctgtcaaattggagtgtccataatatgcttaaacagagaactccattccaataacatgaactttccttatgctttattcatcatcgcttgaaattttgaattttgcccaaagaagtttataccagtacatgttaaattacatcatagccttctttgtataaatcttagagtagtttactgaagtacatcgcaaagttttgttgtttcttaggtgattttaattatgtatgtttactttcagtaatgcatcttttctccttcatcaatattatgttatgctagctgtaagtacaaaataattgagaacaaattatgacaaattgaaccaagccacaaaaaaaggagaaaccaaatacttttgtgatttgagcttttttcagtccttgaaactttaagaatatctgtctttattaacttttgctttttgctgatggtttctctcattttattatagcttatagcattgtaaattaatttaacatgaaaggataaaaacgttgcttttgaaatgtttctcattaaattatgaaaaaatattacactaaataaaagaaaggaatgcctctggtaccagcttctgtttgctcaattattgcagtacccaaagtgaattattacacagttaactcagaggcaatattattgtcattatattataaaatagatgagttgcaatcttcaaaaaaaaaaaacagcataggtcctttgaaagtgaaataccttttttccttgtgcttcatttaaatatatactgaccccagttttgtttttgtttttcctttttagagttcttgctaatgatgggcccaaagttatattaagaactgcaaagtaaatttcaaccaattactttattcaggggagtcattaaattgaggtacctctgaaattttggaaggaatgtactgccaattagccgaaagcactactcaatgtcctttctatggttataatctctctagtgtatttttaattgaagacaacctctatagaggaggtgagaagttgctatttattggtacttgttaggatggaatcaagggtgtggaagatattcatctatttctctctccagctcccccacacaaaaagaatggtgcttaatccatctgaagcatttggggagcgagggtaaagatgtaatatttaccatgagccgaaacagatcttcagaagtggaaaatggaagcatattgaagtccctcaactaaacagactttcttccatatggaattcaatgcattaatgttttcaaattctatagcttcaaattcttaatattttcaaattatgtgagcttatgtcaaaacatttaagtgagcttttaacaatgaggcaaatatttgaatcatttgtctacataacaaatactactataaagcatattaaatgttataaaaatcctaatatactaatgtaagctattataaagtacaaataattaaacaatatttatatgatcaatgttttataatacgataaacacattaaataattaaaaactcttccaccgtgcaaaaatgactaaataaattgttaatttctaaggctttttgagattactgtgaaagggggtatagtttcaggaaaggtgaaacttcccttcaatgtgtaaaccattaaagaacataataacctactgagtgtgggtctcaatgatatgccctggaaagtatgggcaactactccacacccaattttgtctttatatgataaggcacagcaaataattataatgcaatggataaatggtaaatcccaccaaagattaaccaatcagagcaggatgaaaattctgagtttggaaatctattggaagatttacagattagattaaagtgcccagtaaccaaactatcaaaattatatggcttcagttaattaatgatttccaaggtttttagtatactgtattacaaaacacattaagcatcttaagcattcaaacaacatttttttgatgattcagaaagcatcacaaattgttatatcagctgataataacttaggtacatatcaattaaacttgtattatagacacgcagaattcttcagaccagaagtcgaaagggcttctctagtttgtttatgctaagttgtttagagatgacataactctgagctaatttgtctattgcaatggttctcaaaatggggggcgggggatatttttacctccaccaagtggacatttagcaatatctggaggcatttttaattattattactggattggagatacaactgaagtctagtgggtagaggccagatatggtataaaatatcctacaatgcataggatagccctccacaaggaattatttaggccaaaatgtcagtagtataaaaattgagaaatgctagtctaatatagtgtttactcacctttcctgaaactatgtcccctttcacagtaatctcaaaaagctttagaaattaaaaaatcgtttagtcatttttgcatggtggaagagcttttaattatttagtgtgttttatcttatgaaatgttgataatataaatattgtttaattatttgaactttataagagcttatattagtatattaattaggattttatttaacatttaatatgctttacaataatattcattatatagacaaacgttttatttttttcactttaacaatgatttttaactctaattacataagaaaaagtatgagttaacaattttttaaattacatgcttggtttgagggccaaatacacatgaaaatgtggactaaaatttaaaatcaaataaaatctataaagtcgaggaaaaagctacttttatgacgaggcatggggaattcttcatagtttttgggttttatcagaagttagctattttttttctttttgctctgtaaacaatcagataagagaggctcaaatgacattttcaagtacatcttaacaaaatacactttgagcatcaattgagtaaagtttcattcttttgaaactttggttttcacaagatttcctgagagttttattttattggtgttctgtgggacttgggcatcataattcttacaaactactcagctcaatctaatgtgcagcgaagctctgggaacttttgttttgtctagtatccagttggaagattctatagctacagagcttgggtttaaaccccctccaagtctttaccagctacctttatgaccctggcaaattacttaaactgtgtgccaccattttctcctctgtaatacggaggcaataaaaatttccacttttagattttctatatgcggtttacaaattgacttactctgaagatcatctggagtaaaatctggagaaatatgatcccttataacttcttcaaccctttatatatttcaacatgagtaaccaatgctctaaatatggatataaattataagaataaaaaatctaggactattataatggtctaaactctcttcatagctaaaagtgttgagtaattaaaccagttgagcagctaaatcatgtacacacttctttgatccctcccacgatcatgtatttggcattgtaatgaaaagatatgtttattttcgagaatagacataactacctttaataatatgatcacccagaaatttttacaaacccctggaaaatttcatgaatatcaggctgtgctcataaaaccttagagatgagatcacaatagactgggtcaacatatagtaatgagcaggattaataaaacctcagatgggcatttacaaatgagtcaaaaccatgagtataattaaataattgtagcaaaaaaagagccttgggtaatcctttcagcaaacgtaatcgaagtgattgcatttagaagacaaatatttaatttggtgactagaaggtcttttattattccattatgtctttgtgtgtgtgtgtgtgtgagacacttttcaaggtcaatttttacttataaattgtctctaattaaaaattgacttggttattaaatcattgaaaattggccatcatcaaattcctcattaaaatatttctatgtgccatatatatatatatatatatatagaatatatatgtagaatatatgtatacatttatttttactttttttttactgtgcctactagagaaatttaaactacatatatgtagaatatatgtatgttttaactagacatactgttaagtacactatacctaatatttggcaatattaataccatctcattgagaaacctggaatatatgcacattttggatgtctattatatgttgggcactggactagtcattgataatacagagattagtaagactcaggttgacttcagccatgttgtcaggaagcacacactctagtttgggacagcgaggagaaattcaataagagaaatatatataaggcataatgctctaggagaatatgcagtggataactgcccaataggaccaggcaaggctttttagaggaggaggtggcatttgagtcaagtgttaaaggctgaatggaaattcactggttgagataaactccttaggaggaactactttaatagaacttgccgttagtcctgaaataaatggtgtgcaaaatcattaccatctgtcaattcactcagtctactttgctcttaacttcagaaaaaaatcagaaatacaattaaaacatttgagcctattttactgtcttttaaaatgagttaattcaaagaggaaattaaatataatgagagagaatctcccccgaggattgggggctggggaaatgctattgattctttgcttgtgtttattttctctcaaaaatacattatgcataaacttgatgatcaaaaattcagattattacatttctaaattggcaatgcaatttattgcatcatacatcaatcacaaaaatgctcatcttgctgactttcataaacttctaaatgaacaaaaatgcaaaaatagtttatactatattacactatagtagatttgttaaactaaaccagaacaatggtccatgaaaaataggcctctgactccaaacgctcacaccacaggatctctctgagatttttgtgtcatttcaagtcagagaaaattgtctaataaattgttggcttgtaacaatgaaaactaagatatctgtggggctattcttgttctcttcattttactacagcagctctgcccagtagaaataaaatgtgagccacatatgtaatttaaatttctctagtaggcacactgaaaaaataaaaataaagaagtgaaattaatttcaacagtatgttgtatataacccaatatacccaaaacattgtcattttaacatgtaattgttacaaaagttattaattagattttttccgttaagtatttaaaatctggtaagttttactcttacagcgcaactcagttcagatcagccacatttcaagtgctcagtagccatatgtgtctagtggttaccatattagaaagtagtttgagagatccacattaaaccaaaaggaaaagaacttccggcccttcactgatgagtcactcttcactgctaaccttggaagcattcccaaatgtagtctacagagtttaaatagtctatcttaacatctctcagggcttcagtcttaatgccatagtatttttaaagaatggtggatattcttttttacagaacactctgtaagagcaattagaagtttatgatgcacgtaatgcaaaatacaggtcatttcccaagcctattttaaaagcgcaaaaactgtagtcatttatcacccctgagaatgttgtcttaaatgtcttggtttggatattggtgatgtgagaactttgtgataagaaagtagtctttaagaataagatatcagactaaaattcatatctagaatgaaagtcttgtttttaatggaagattaagagcaagtctgattcagatcatgcatggggtacactagtctaggaaaacactagtctgaaaatatactaaaagttacttcgcaacttaacaagaaaatgtcttgtgggtgatgtcgttcttgatttttaggcaaacctacctacctttgcaaagcagctgggacctttttgcattggaagaatcatttggagcacaaacaaaattagattatcaacactttggaaaacaactacgaatgagcaatcagaaacctgaccttaagattacttgtgaattgtgaatcagcaaaataaactcgattgttcattgctaagtgtatttcaattatcaagggccttctagattataagtagtcttttttttttacttagtttacaattaagatgtgtggtatttgaaatacatttgccacagggagaaatataaattataattaatttcctaggctaattcaatttatgacatacctatatacattatctgtcatctataatttttcccttattgtttacttcccactggaagaatgaaaatggaatattattacatggcacatggcttgatacttttacaaactctgacaattatgtatttattttgggaggcattgagtttatttgttttatttatataaatttatgaggtacaagtataattttgttacatgcatagattgtgtaatggtcacgtcaggccttttagggtatccatcaccttaataagatgcattgtacccattaagtaatttctcactctcataaaattctaattatgtgaatttaatttaatctatttaatgtgttttaggcaaatatagccggtactataaacagttgattttaagatatcattgcttacattgagactaagtaaaacaaaatgggtcaataaatgtcaatctagataacaatgtcaactaaataagaggtcaaacatggcagtatttttgaaggtgatctgtgaaagtgattatagcgtttacactcatggaaaatgccttcagagtttcaactaagaatgccaacagctcattcctttatcctgatgcatattgtcttccttctcacccccagttccttcttcccctaacccctacccgctttcctttgctgattttgacagaaataggacccccaataagtcagggagatagcaggaaatgggataggatagaacccggaatgatagaatagctgagcctgaaggcatgaagaaaggctcctcctgacatctaaatggagacctaagagatgggttggtcaggtagggggaaggaaacatgaggagtattctctaagccaggcaacatactgtgcacaagtctgaagtcatgggaaagtgattttgagaggattgctgcttggtaaacctagagtttgaattgggagagatgaagctagaaagttagtaagggtcagattttttttttttttacttgcatgacaatggtaaaaaccactaaaggttctgtgttaagcagaggagtgacttcatttaaaaaggtaaattggattgaaatgaagggcataaactgaggcaaaaatatccttcgttaagttattgaagcccagttgaacacactggtggcttaaactggagtattggtataagtgggggaaagaggttaatagattccaagttgaaaaaaaaaaaaaaaaacatagactttgctatctagtaatggattaatatacaaaaggaaaaagtaaagtttctactttttggacagctagaaaccttcaccgaagtagggaacccaagacttagattatgttgggaggggcagggtattttagttgcacagggatttgctttacagaaatgactgaatgacaatatagagagatcaattccattaaaagaagtttgattactcacagttctcaagggaagagtacatactacgccatgcaaagccatgcaggaaaaaagttccagagtcggtcagcaggcagaaaaggaaagcacagcccaaaccctttattgtggtttccaaggaaaagaaatgagtgaggtagaataggcaagtctgagcaagtttaggactggatagttcaaataatttccaaaatttcctggctgtaaaagtggtctctggttgtctggtaccaagccctagggtgaggggaaaaagttagggtgggggaaatattggtttggtgtaacaacagttagatgaagaaggtagttggggatacggactttggattagttggtttgtataacgaaaagcaatccaacaaatccacaagggagcaagtttacaagttatttgctatctttaggaattagctagccctgggaggggcagtctctccctggccttccaaggacctcaagatgttcaagcatccataaaatatggaaattttttaaaaacattataaatacacagagtaaacgctgggcatgatataggacagtggttctcaaactttagctccactggaatctcctggaaaacttgttaatatgcagatgaccgttttacccttaagcttctaattggggaggtctggggagggcacagataatttgcatttctacaaagttcttccatgattttgatgccgctggtgagggaccaggctttgagaacactgatttaggacgtgtcctgtttagggaatatccaaaaggcggacaagttcagggaatattcttgggcagttggctgtgtgagtctgaaattcaggatagaatattaagctgaaataaagatttgggagcttatctacagtcaaatgataattgaaatactgagagtacggggggagagaggtccatgtaccaagaaaagtgaaaatgactaatcccaagcctcgctgaccattgagaatggagctaagtgagaggagttaacaaagctgacccagaaaaagtcataagggccttaggaggccaaggaaaaaaaatacattcactgccaacgagaggcacttacgaatggcttgactggctttgccagcatgcatgaactgcttcataattatttgtattgattacagtaacagatacatattttaacaagcaacttaagtaatacaactgatttttaattatcttgtttaaattgataaaggttgtatatattcatggtgtacaacatgatgttttgatatacccatacattgtggaatggctaaatcaagccaattatcgtatgcattacctcacatacactttatttgtggtgagaacacttagagtatactcttagcaagtatcaagtatataatacattgctgttaactatagtatccatgttgtacaataggtctcttgaacatactcctcctgtctaattgaaattgtgtttccttcgaacaactgatttttttaaataaaaaacttaatacctgtaagttagaattcttaatggtcaccttaggagcctatacaattattcctacgttgttgttactattctgtgtctttttcttttttaacatctttaaaggtatcaaatttttatattttgaaagtagaatttattttttgtcagtctaaaatatttttatgttgaacaaaatgcatgaatggtaaacctagatgcaatcaatttttcaaataaaaaaagtagatacccatgaacatttcttttgtaattgcaaactgtcttgaaaggcagtttcaaaaagagtttagttcctaaattgtaccattactcactgcgttaaaatgcaacattcatttgagcgtataaccttttgatcaatttgtttttgatgtcttgttccctgagagttgtctcaaatagatacatataaatatacacatatctcagattggctctgagaaatgtcttgattcaaacgttcttgattctaagattcatggtacataggaactgtatggtgacaaccttgtcagcctatctttagagtagctttggattctattcagaacatttcccaaagctattctgctatcaagaatataaacaggaatagtcaagggaagctttttaaagggcaacattttcatgtaggcatttttctcacattgaaaactagtttactaaatgcagtgtattaccttctcattacaagaagtctttcacattagtataaatgcatatggcagttgtgccagaaataaattgcctctcaaactagcacatggaaagaagaattctgagatttagcacatatgtagcttttaaatagtatactctgtttcaaacattatgtgttagtccacgttctcttcagccattttcagttgcatttttactttatattcctttgtatatttatctttgctaatcattgtcctgagattcctttagctcttgaattctacgtttttaattaatagaaaactttctttttatttttcccccgacatagttgttttctagaaagaaacagttataggttataaatccaacactttagggccgacttgaacatgcatcaaagctactagaggacttgtagaaatacagattgaatggtcccatgcctagagttttacattcagttacagatagggtaggacctgagaattcacattgctcacaaatttccagttgattttgatggcattggtctagagaccaaaccctgagaaccattaaaaaacaaacaaacaaaaacaaacaaaccaaaaaaaaaactatatacagagattttcttcattggcttttgccactgaagacatttagatgaagagactccacaaagtgtaatcatttagttatgagaggggcctgataatttgcatttctatcaaattcccaggggatactattgttgctgattgagaaccacacttggtgaaacactaattaaaataccattaaaaagcaaaaacaatttaggccagcaaaacctcctaaagaatgaggcctaaagacttattttgttttatttttgccagaagcttcttatgggcaaaattatcaccaacagagctgaggttcaaacttgtgttcatagcaagcaaaagggataatttggaaaaaaagctgaggttagctttgtggttggtttgggagtgggaatgagtagggaggaagaaatttaaaaaaaaaaaaaaaaggaagaagccaaatattaaattgttcacagggcgaaaaaagagaaaaggagtaactagaaatatcttagactggttcggcaagtcgggtccctcgcagctaacagtggtcccaccctctggagtttatatgtttacattctttttttttttttttttttttttgagacagggtctcactctgttgcctaggctggagtgcaatggtatgatcacagctcactgcaacctccacctcctgggctcgggtgatccccccaacctcagcctcccaagtagcagagactacaggcaagtgccaccatgtccagctaattttttgtatttttttgcagagatggggtttcaccagttgcctaggctggtctcaatctcctaggctcaagtgatctgcccacctcagcctcccaaagtgctgggattacaggtgtgagccaccgcgcctcattggagtttgcattctagttgggaaaatagccaataaatttgtgacttattttcctttaaaaaaaaaacttattctggctattgtgtgactataggatatggaaggtgcaagagtatgaggctaacaccctgttctaaattccgtctcctctgagccttgttctgtcaagaatctcctccttctatactttttaagtcaccttcctactgatcctttgctgtcagcttaccactctggtacccttcattttaacaaacaaacaattgtccaagcttaccggtgctgctccttcacccctccacctgtacctagtgtcaattctctccctcttctgatggccaaactttgtgaaactgtagcacagctccatatgtgttcctgcaaaggacatgatctcattcctttttatggctgcagagtattccacagtgtatatgtaccacattttctttatccagtctatcactgatgggcatttgggttgattccatgtctttgctattgtgaatagtgctgcagtgaacatacgtgtgcatgtatctttaaaatagaatggtttatattcctttgggtatataaccaataatgggattgctgggtcaaatggtatttctggttctagatctttgaggagctggaagccattatcctcagcaaactaacacaggaacagaaaagcaaatatcacatgttctcacttaaaagtgggagctgaacaatgagaacacatggactcatggaggggaacaacacacactgaggcctgtcggggggtggggcgaggggagggagagcattgggaaaaatagctaatgcatgctgggcttaatatctaggtgatgggcaatagcaaagacttggaaccaacccaaatgtccaacaatgatagactggattgagaaaatgtggcacatatacaccatggaatactatgcagccataaaaaaggatgagttcatgtcctttgtagggacatggatgaagctggaaaccatcattctcagcaaactatggcaaggacaaaaaaccaaacaccacatgttctcactcacaggtgggaattgaacaatgagaacacatggacacaggaaggggaacatcacacaccagggcctgttgtggggtcgggggaggggggagggatagcatttggagatacacctaatgttaactgacgagttactgggtgcagcacaccaacatggcacatgtatacatatgtaactaaccttcacgttgtgcatatggaccctaaaacttaaagtataataataaaatatatatatatatatctctaggtgatgggttaataggtgcagcaaaccaccatggcacatgtttacctatgtaacaaacctgcacatcctgcacatgtaccacggaacttaaaataaaaattaatcatagaactttaaaaaaagaaaagaaaatgtagcagagctgcctagctcaccttctttacccacagctcacttttcagtccatttatctggctattactcctaccgtgccaggcaaactgctctcactaagaaaatcaatagcctaccccctgccaaattgcctgactcagcttctccttgtaattttctcctttagttctctaacaccctcttccccaggttttcacctgacctgtctccataggacatttgagtctctttcctgatgattcatcctcagcctcttccataataagtatggctgctccccagatcctaccctcagcacttcttcactttccatgccacatctcttctgtgatctcatcttcatccacggctctaattagtatctataagcagatgactctcaaagcatatgctgcctatgtacccctcttggccattctacattgacatctgcaactccccagtgaacttctatatttagaccacaggactggtacctgctgataagcacaggtagggtgtactgagtagtgttttctctatttggttgggcttttgctaaagcagttgtcaaatattttgagtcttactcatggccacagacattttaacattagcatgtcccaaactgaaatcccctactgcctctattctctatttcagaagatggcaccaccatctacccaattatttaagctagaaacttctgattctggtgagacttctctcttttatgcatatgtctacactgacacaaaagactgcaaattttacctcctaagtctgtcttaaagcagatttttctctatgattctctatggtttcaggcccttatcactgtgaagtcaagcatacctgattcgaatcttgtcaccgttggcaaatttttaaatctcttctagcctcagtttcctcataaagttttctgtttcttagggtgactaaagggcttaaatgagattaccatacagagagtaaggtacataaaatgcaattaataaagaatagtcactataactgctgatgatgatgctattactattcgtatcctagaaaactccggtaacttgttcactggtctttctgcatctagcatcacttcctcagccagagttatcttctgacatgaaggctgatgccgtcacccccatactcatgtttgaaattcttcaatacctttaagataaattcccacctccttggtgtagcatgcaaggtcacacatgacataatctctccaaggccccatttcttccactctccttgagtgatatatgtggcagaaaatttaaggctgcctggatattatccaccttacgtcccaatacttccatctgccgcaaagaccttctacccaacttcccatcctcaacgaattcttattctttctttaaaaataacctcaaacttcagactagacctctggtccatagggcattacaaatctctcagtaagttgtacaggatgaacacgccccctaaaactttgtttcagatatttcaatttttattttattttattattattatactttaagttttagggtacatgtgcacaatgtgcaggttagttacatatgtatacatgtgccagatatttcagtgttaaaggtttaataatcacatttacagaaaaggaattagctacaaaatggtggcactggtatacaagtatgtaaagatacagtgcttacaatttaggattattgttgtcgatgttttaatattaaaatggctaatcatacagcaaagtcgaaagaaatttacggtcaacatctgtatacccagcacctatactttgccattgaaattttactatacttgatttattacatattcatctatccatccctctttctgtgatcaatttttaatattctaatactcttacccttaaataataagttatcttttcaaaaaataatgtgtttttacatagatgaagcaaaataaacttgcccttgataaaacaatatgcactgtagtgccttctaattcagtgcattgaagtatccattaacaatataaccagagaatataaaacatgtttattaatattccactgtacctgattagatatagaccattaggaagagttattataattaagaatctaggtttgtcaatatagaaaaaaacctgtgttttttatcccactggaatgtcttgtgaggaatattgttcccctttttctaaaatttaactttgacctttattttgttaatgcaccatgggttaagccacactacgacatgtgctaaatagacctggaagttttcaaactaggtttttaaagtgtatttgacattaaatcttcataacaccttattgattaatttaaatccattaccatggtaaggaaaattcgcagacaggcaggtgaaaattaaaatagaaacaaaacaacatggtaagcaatccttccccccaagccaatcagcatgtagtcagtgtgtccttttaaattagcaaggcgcagcttcccataaagtcccagcttgattttatatgctgcaatagtattgctaaaataaaggagaaggcaacttttctctataatttttttctagaagttttcacgcagcttagtatactgcaatgaccacattactcagttccagaattagcagcattccattgtgaatgacttaattcacattgtgattactcatttaacaacattcttgagggtttacaatgtgcaaagcattacattaagtcgtgtgtggcagaggttctcaaatgcagatgatctgtgaagaagatttcctcaataagcagagaaatgagaactataaggacagaaagagagagagagagaaagagaaattatttaagcttgtagcttgtcatcctcctttcttaggacagcctaccatttaggctgagactatgtctttctgattatttcttgtggttgaaataccccttccttaacaatatgatggtaacagtggatggtaaatcttgttttgttttaatagtttacctggcaaaagtatcattttatgtctgtatcagttatatataatagtatatcagtccattaccaaaccgcctcaaaactcagtagcttaaaacagtaggtacttcttgagttcactaatttgtgggctgatggtttacattgggtagtttatctgctctgactgggctcccttgggaatctggagggtagctgagagcttaagtgtctgaaagtggctgggtcaacacagctctatcgctcacatcttgaacatccctccagcaggctaaccagcccgagcaagtcctttttgtgaaggctgaggtgaagagtggaagtgcaaacatgtaaacaatttgttgagcccctgcttccattaagcctgcaatatccgattggctaaagcaagttttatttccccctgtggtaggcagaatcatgggcccctcgaagatgttaatccccagaacctgtgaatatgctgtgctccctggcagtagggaattaatattccagacggaattaaggttgctaagcaggtgactttgagatggggagattttatggactattcagatgggcctaatctaaccacagggttcatataagtgaaaatggaagcaggagagtgggagtcagagagatgaagatagcccctgctggctttgaagatagagaaaggggccattagccaaacaatgttggtagcatctaatgctggaaaaggcagggaaatagattgtcctctaagcttcttcagaaggagtatagccctgccaacactttcattttaatccatgaaacccatttcaaacttctgacttccaaaactataagataatcaatttgtgttgttttaggccagtaagtttatggaaaattgtcacagaagcaataggaaacaaatatacgctccattgttcaatcttttgaataacacatatactattatttacttaatgtttttcttaaaatcagctcattttgttttctgcttttagccttaagtgataattcccacaaaactgtagtctgatgttgcagtgtttttttccttaatacagataaaactaaatgaatattaaaatttaaactataagctgtttatctgtgtaacatggtaaattggctccctaccactactgttcagcaaaccacattttgggaaacagcgatttaggtggttcaaaggagcaagtgattgtgcaagaacaagaatttattagagaaagaagcatttggccaatgggtagaattgttggcagacaaaggtagaagagaaagacaaattattcagtatggctctagcgaactctttgcacttttatcacacaatctgaagcttgctaatcttgacatgtcttaatgttgttggattgctcattaaactggctgaaatgttcacaaagactctcacctgtcttctggcttaagctgagatttatcacacttcttggaaacatcttctggtctccagatctccctcagctaagctatacagtcagtctgttctgtaagaaagcccaaacttctctgcagtgttcctcagtctttttgatatcatgatgaacagattaagttgatgtgttcatcatgatatcaggtaagctggccgaagactctaagctgcctaaccatcccagggctgagagggatcgatatctgaagtacctataacccaatcagggcatgtgccttagcatacccattggaaagccctgttttagagcctttatcagctgtgaacttattgaaggcaatgattttgtcctgttaatcattctattcataattttcaacaagatacgtggttgttgttaataataattgttggttgaaatgaagttaaataaatagcaattgacttttccaaggtgacgcattgcacagatttatttatcttccctttgctgccctggagtaccagttgtatctaccaataagcttcatttataggccagcctcatcttagtttctgaattagtctaagtggctctggtagcgcatcaaaaatcttgctttctgatggtctttgtaatttgaattctgtgacttacagacttggtattcaatatgtcaggaataaacctggggtgtgcccaaatggtttgaaaaatcccagccttcctgatttcctctcttctctttctcccctggccaccctaatagtctgatagtttttgttatttggatactcctaaactcttggcaatttttcttacatctgttctctacaggctgtcacaagtgagtggaggcaggatggcatgggctgcagtggaaagaccaagaaaataagttaaaagccctgggttccagtaaatgctctgtagtgggatttagggcaagtctcttaacttctctcagcatcaatctccgcatctgtgaaataagattaatgacacctgtcttgcctatacttcaaggttgttttgaggttcacatgcattttccaccccatatagcctataaatctctgatgcctacagataacctataatgttctccagtaagtttaatatttccaggattttaaaactcaatgactagcactgctctgatctaacataacatattgtgtcaatatgtgtgggagtctctctggttgatgttaatggaagtttgtatagtttacctaaaatagaataaagctataatattaatatatatcatcgatgtgttttaggtgatttttttcaatataaaggcaattttggttcaaaattaggtagaacatttaatttttactaatttacaaataaaatgataacatcaaaagggccccttcttttaaagataagttgtaactctcacattgatagtaatctgtcatttaggacagggaatccatgtagtttgaaaattcattggcatcatggagctaaaacagtggctttttaaacatgtcgatttcagttttctttgttttacaagtcaagtagtgatattactgggtacatatgaagcatactgattgaccaaaaaatagtaacaaattttgtaaacccttcacttaaccattattcacctttcccagccacataagaatcctttctctttgtccttagattaattgcctttctttaaccttttcaattctaagtccagacaagctgctgtggttctttaaaaggccacacaaaataagtattgtccagtgctaacactctgaaatgtgatattgtaattactaccaagtgaacattaatcactactagattagaatggaattacctgttatattcacattaatagcaaatgagctttccctgattgatgttgttataatgaatacaaaaggaattaatagtgatctggcactcaccaaaagaggggtagtcattaaggacatgccatcaaaaggcgggtaatactttacaaaaaacaagtattaattaaagtaatatcacaacgaatgcctattgaataacttatatccacattacaaagatattatatggttgcgattaatgtgattgcaatacattttgtaaaaattaataatgactaaccctttaaaatatttaggaagcagatatttgtttatatttgctaaatagctatgccaactctttagcttttgtgagtgacttctagcataggaacagtgatggataatatgaagcactatatataataactcatcggccgggcgcggtggctcacgcctgtaatcccagcactttgggaggccgaggcgggcggatcacgaggtcaggagatcgacaccatcctggctaacacggtgaaaccctgtctctactaaaaacacaaaaaattagccgggcgtggtggtgggcgcctgtagtcccactactcaggaggcagagcttgcagtgagccaagattgcaccactgcactccagcctgggtgacagagtgagactctgtcaaaaaaaaacaacctcatatatttttacttgaaaacatacattttgcctttaggatttttacttgttagaatatcctaaaggacctataattgtaaatgtaaaattgactaatttctgggttttaaaaaaaagtatttgaaagctgatctgctgtgaacattgaaccagatgttaagaaaaatgctagtaagaaatgagacttgggagcaaagaagcagaactaaacttttcatatatggtttctatggagtaattgagaacgtacatattaacagggatacaaagtcaggccctctcattcaagatgctttctgtctttaaaaaaaaaaaaaagtaatttttgaaattttctgtggcaacagtcccatagcagaaagcaaagagttttgaattaagtgatcagaatatcattcttataattttactacactgaacattatttagaaaattttgaatgatattaaaaccgctataaaacatacttgcctaccataagacttaggatttaagccagattaaaataaatatttatttagaaggatgtatgtaagaactggtgaaatataaatgaggtctgtatttgagttaatagtattgtgccaatgtcagtttcctagctttgatgataatgtactatgggtatttaaaatgctatcattgggagaagctgggtaaaaggtgcgtgagaagtctctgtactatatttgcaagttttgtggtcttaaaccatttcaaagtaaagttattttagaaaatatctaaatatatattttagaaagtattatctttttctctgtaactagtggctaattagctcagtctgaaagagtatgtagaggtggaactgctaaatatatttctgatctagacttacttgatgatgcttgaattagtaagtgaatgttatgtgccaacatatgctatgatacatataaatatataagattaaatgataggagctaattatttcttggcatgttgcagtgggtccatttaaaactgtttatgtaggaaactactgtaattataaaaatgagcacagcccaacagcccagtatattagttgaaatataaaaggcgttgtgtccaagatttgaaatgccttacaataagcttggcacttacttaccttcacacaaagcagacacattttattgtgattttagtgttccatattatatggtacagtaccaaaggaaaactctaaaatatgtactcaaaatcctgatgtgcccttctttccaaacaggtggcaccacaatgaatataacctttagagttaatatctgaggacaaacccagcagttacaccagcatgatttaggtcctgctgttacaattattattattgtatttatttcacaattaagttgcagagttgagctcgatatagttccagctgtggcttttttttcaactgtctcaatagttcatagatatggccaaatgttcaataatagtgaaagcttatagtccacatattatttctgtagcaccaattttatgtgaaaaaatgatttatctaaatctcagagaatttccataactagttttgttatacatctacaaaactaagttaaaagaacagagcagactttttaaatagctagattggccaaatccacctcattatcatcaagaagatactgaaacaccgtgtttatacaacaagaccaggcattgtaaaagaggaggaaaggtagagacaaaatttatttagccctcaggaatctttcattctgatagtgtaaatttgacaactttagagggacttattaacatgtatcttatatatcttgataccgaatatatattttgtgattgcattagagccatgaaatattacacaggtcatttgaacatagcattttcatagagaaggtgacatttgcaaaagattaggagaaaagtaactacgattagaaaatcgtagttttattttgtctcttgagaatgaattgatgttaattttatgtctgatttggccaaatacgatgtggaatttgctaaagactgaaaaaagaagagacatcaaatagagggttgcaagttaacagaccatgttataattaaatgagggaaaaaaaagtagagttgttaaactcccagagaagtcatttccccttggtttggtgcatttcactttggtggtgaagtaaatgaccatatgggcacttttctagctctgtccgcaggtagcactgggtatttgtggacaaattacctagcttttcatagcactagtttccttgttgatagacttcagaattctaaattccattttacatccttatttctatgtttaacttaaagataatcctttgcagccgggcacagtggctcacacctgtaatcccagcactttgggaggccgaggcaggcggatcacgaggtcaggagatcgagaccatcctggctaacatggtgaaaccccatctctactgaaaatacaaaaaatcagccgggtgttgtggtgggcgcctgtggtcccagctactcaggaggctgaggcaggaggatggcatgaatccgggaggtggagcttgcggtgagccgagatcgagtcactgcactccagcccgggcaacagagccagactctgcctcaaaaaaaaaaaaaaacaaaaaaaaaaacaaacagatcatcctttgcactggaattatcctgcagtggaggatagtaatgaaagtgtagactctgtttctgaacactagctatgtcactttcaaactgtgtgattttccttcaagtttctcaatcactccaggtctggtttctaaatagaggaataggagtagagattaatattgtgaagattaaatgagaaaacttatataaagcacttagtacggtgccctgcatattgtgaaggcttggtatgttgttagtagattcattttattatcattattaataatactgaaccctggctgttgggggaattggttctatcctcctgtctcatagtcaaaataggttaaagggccttctatctcttatttctggtggtgcattataattactaatagtaatgtgcttcatttgtatatgatcctttatagtttacatggcgctgttttatgtaatcttactaaaatttcaaaaataattttaaaaagccagaattcacaagaatgtgactcggagaagaagtagatgtttttctaagtagatctttcagtttaactgattcaaattttctcatgtttcatatacatgattatcatgtcttttgataaacagaatgttaaccagagtacaaccttgtatgaacatatttattcagcttagaaaagatccagaggtacaaaatctagatcccagtgtagaagttagcatacacagtacaatttctagtatgtccataaacaatatgttaaagtattagtttgagccatataggattgccaatatctgagtgttatagagctacaaaattagtaggaaattttgttgctttaacctaatcattaaattagaattgtgtgacttaaagttacaaatggtttccgaatattttgcagtaaaaaagtagtgaggaaaataaatataaatactaaactagacctgggaaatttaaggctataaagaattctagcttacagagagaggagtctttgtttgcaacctcccactagctaaatttaaattatcacaaatttcatcctctcctttacttaacccttgactcatgcaactagtcaaatgtctttttcttgctaattttttctttccatagatcacttatagggagttctggttaaaaatgatgtctctttaaccttcactaaaatgagaataggggaattaaaatgatatttaccacaaagagaaaaaaatctgggaggaaaaacaataaaataaaaaagataaaaaatttaggaatatgcagagaatggaggagttagcatatcttggaaacctgaattccaagtacttagaacttgggaagtcctagaaatgtgaagcaccagctactgcagaaggcagagatgaatgtgaggtaagatagtgagactgtgaagagaaatcattcagtaaaaaatgcattatcaagccaactgccactggtctagtggagtttaatcccactggggaaattctaaatggattgaagacatgtgtttaagagttagttattctttcaaaggggcaagggagctggggtatttatacacaaaatcctgctagtcattggtttaggactgcttccaacgggggaattattttcctagcatttctggcataccaccttggcaagaaaaattattttgtgtccagagtatgtctaaagccattagggaaaaaaaatgtggatcctcatagttgaaagccaggccagtctgcactaaagtggtaaggatgttttcttttagagatacaggtctaagaaagaaatctgaaggtggttacctcttatgcaagaatttaatttgatggattcaaggtgtgttggttaagagaaatggggaagggttgcttctcatgactgcggcacgattctactatactaaatttttcttttattaagcagcattgccttatgcaatgataggaaacatttgttatatgtgaaatcacttttatttttattttttaatctattcctattcttttcatttttttaacttttattttaggtttgtggggtacatgtgaaggtttattacataggcaaaccggtgtcacaggggtccgttttacattttatttcaccaccgaggtattaagccaactactcagtagttatcttttctgctcctctctctcctcccggcatctcttttaaaagaaaataatttttagcaattctttagaataagtcttggccacctaaaggtttccaggactctagttcagggagtatttatctaagtcagtagttcttaacctgatataatttcatccccagagaacatttgacagtatctcaagaaattcttggttgtcacattgggggcggggatactgctgtcatcaagtgggcagaggccagggatgctgctcaacatgttgtaatgcacaagacagccccccacaacaaagaattatttggtccaatatgtcagtagtgccaagtttcagacatcctgctctaaatcaggactgtgatgtgaattctctgcgatgatgaagatattttatatccgtgatgtgcagtactgtagcatatggctactgagcaattgaaatatagctagtgtgactgtacaccaggtgtgatgttccataccgaggaaagaagtagaaataagatatagtctttgaagtcagagctcacaatctagtagcggagacagatttttaaaaattacaatattttaaaaatattgcaatagaacatggtaatgttagaagattaataacatgctaaatttgaggcatcaggactcagacagacaattaaaaattctctgaggtgaatttccacccttagctcagaatactgtaatgtttaaaagctgttttctatacacacacacacacacacacacacacacacacacacacacccctttaaatcttttatcatgtaactcattgcttcttattttacccttttgtcagagaatacatataaaatactggaatctgatgggacattctactttatttaacaatgctattgagtttctcaaaatagtttcctaagaaagtctattaaagtattgattttttcataaaggataatacaaatggcatgagtctgtttaacattttaatcaagcttaaaattagtcttgcatttgaaacaaacttgcccagagaaattgttgagaaacttaagagaaaaacatcataaaaaattgatgggccagccaggctgtgagaatattaaaatccaaatctaaattatggttaaccattgtcacatctttctttgaagcttaagtaactcgatattccctgtaggatacccagtgattcaaagtgacacatatactgtcagctcattttccttcccagcatgctggtacaatttgtatccatagaaatatatggaaaaacctattagtcttgagtgccagaacctaccaaaaggaatctttgtcatctacaaataaattaataacataagataaacaatcctattaagttatactggcccgaaaagggaaaaaagaccagtttatgaattgacaaaagaaggtaaatgagattagccatatagcaaccactcagataataatgtgttttctctgtttagtaaaaaagcatatttgagagaaaattttcccttatagaacaattcttaataatatacatagatactcctttcctgggatgtagagtttaatcctcccctaagcccctccatgaacttggtaacttacttccagataatagaatatggaaaagtaggaataacaatggagaagaaaccaggcaggcaccaagttaactaagtagtcaagtataacatcgccagtgataataatattgatatcatgtctcctgtgatatgatgtcatgaaaaggacatgttatctctctggtattcttccccaaaacctgtaacttcttctaatagggaaaatacttcagtcaaatcttaagagacttctagaatatacctgactagtcctattcaaaagtttcaaggtcatgaagaacaagaagaaactgagagactgtcacagactagaggagaccaaaaagacccaaggaccaaatgcagtaggagattctggattggatcctgaaacagaaaaatgacatgagtggaaaaactggtgaaatctgaataaagtctgtagttttgttaatagtgttgtatcagtgtttgtttaaatgtttagataaatctctcatgcgtacagaagagttatcattaggggaagctgtgtgtcaggcacttagaaaactttcagatacataggtaccttttgtaagtaaaataatgaattaatgggtcattttatgtctgtattttatataaggctacatttctaaagagacaaaattgtgagtcccataaaaatataaaatgaatatgtgtaaaacattttattagatcattaactgatgaaggaattagtaagatgttagttacagttggttcaaaggagagtctgaagaattggcatatatatatacgtatatatacgtatatatacgtatatacatatatatacgtatatacgtatatatacgtatatacatatatgtgtatatatatattttatatatatacacatatatatataaaaaacactctagaatgctgataggaattttataacagatacaatactgatcactaactgtagggcaggaatctattgcgttccatgagaaaattttactggcatctagtgaacaagaatcatttgtgtcaccatcagccctccacaaattgacttttaaacgtacagaattgcaaaatagcataaccaaagtctaaggtacagactcttagataatcagataactcctaaggttttcctaaggaattaaagggaaagagacattctcagattaaggaaaacaaagaatttcttgctagcaaatctgctcttaaagaatgacaaaaagacattctctaaacagaaaggaaattataacgaagtcttgacatttcagaaagaaaatagtagaatgggtaaaaatgagagtaaaataatagactatcctatttaccataagtttgaagtgaaaactttaacaccacctgatgtggttctcaatgtatgtagagaaaatacttaagagttatattttaaaagaagacatacctaagtggaagtaagagtccttctacacgtcacctgaagtcaattccagtagattgcaatgttaatgcgtatcgtaatgcctggaaagaccactaaaaaactatacaaagtgatacgttaagaaaatacaacaaataaattttgatggaatcttaagaaatgttcaaataacccacaagaaggtaagaaaaaagaaagagaagaatgagaaataaagaaaacaaacagaaaccaaataaggtggcagattgaagccctaatatatccataattaccttaaatgcaaatggtctaaatataccaattaaaagagatttagctgagtggattgataaaagctgagcacacaatatgccgtctaaaagaagtttatttcaaatacaacctaggtaggttaaaattaaaagaatcgaaaaagttacattatgcaacaattaatcaaaagaaagcagcagcagtaatgttaatatcagataaagtaggcttcattgcaaagaaaattactagtgacaaacagggacattacataaagattaagtgttaattcactgggaagacataataatcctaaatgtgtttgcacctaacaacagagcttccaaatacatgaagcaaaaatgaatagagctgaaaaaagaaacagacaaatccatatttctagttagggacttcaacactcctctctcttcagttgatagaactactaaatggaaaataagcaagggtaaagagaactgaacaacaccatcaaccaataggatctaattgaagcactcctcccaacagtagcagaatacacattactttaaagctctcatgaaacattcactgatataagccatattctggactccaagcaacttcagcaaatttagagaattcaacttatatgttcccagaacataatgaaaccaagctagaaatcaataagagaaagacaaaagaaaaacctcaaaacacttggaaatgaagcagcacacctttaaatcattttccccaggtcaaggaggaggttgcaaagaaaaattttttaaacacaaagaactaaataaaatgaaaataaaacatcaacatgagtgagattctgaagcaaagggcaagcatatctactgtctatttttaaagattaagcttccttaagctcagggtttctctcctgtgatgcaatccactgtgtgtacaggtgtctcctgaacttctttgggattactctgtgggaactggctcaataaaatgttggttctttgactactgctttgctgtgagtaatctagtctttttctctggcaaaaaaaaataaagtgagatgtcataaaagcagtattgagaataaaatgtatagcattagattatttagttagaagacaggaaaggtctaaaataaataaatgagcctagagacaaaaaccatcaacaaaatattaaataacatgcgtcaaagtttaaaaaaagagtgtcataccataactaactgggatttagtattgaaggctggctcaacatttgaaagttaattagtgtaatctaccatatcaacaaactaaagaagaaaaaatcatatgattatattgattgatgcagaagcatctgacaacacccagcatccattcatgataaaaactatgagaaaactgggaatagaggataacttccacatcttaataaagggtatctacagaaaactacagttaatagcataattttaataatggaaggcttaatgtttccacccatgattgctaattagggaaggatgcccaatttcactactcttttttaacatagttctggaagttccagacactacaataaagcaaggaaaaacaataaagcatgcatattgaaaagtataaaataaaattatttctatttgtggatggcatgactgtgtacgtagaaaatatcaaatattctacaaaaacaaaagcaaaaataaccaaaaatgctcatggagctgagaagagaggttaacaagatccaaaaatacaagatcaacacaccaaagctagtcacatttttatatacagatgctcctcatcttatgatgggcttacatttagataaacccatcataaagtcaaaaaatcataaggcaagccatcacaacttacggattatctatgttggaaatgaagatgtgaaaagtgaaattaaaaacacaacaccatttataattgcttatccaaaaatgaaatacgtaggtataaatctatcatacatgtacaggatcggtatgtagaaaattataaaatgctgatgaaaggcattaaaaacaacctaaataagtggattatatggcatgtttatagactggaagagtcagcatagcaaatatgtcagttcttctcaaatcaatctaaaggtttaatttagtttctatcaaaatcttatcaaggatttctgtacacatagacaagcatactctaaaatctataagaaaagtcacaggccacagaataactaaaacagtcttttaaaaaggtaaataaagtgggagtaacctctctacccaatattatggctaacaatatagtaaggctatcaatacagtatgatgttgctggagggatagactcatagaccaaatgaaacagaatagagaacccaaaaacagacccatgcaaatgtgcccaacagatttttgataaagttgcaaaagcaattcaatagagaaagctcaccttttcaacaaatggtcctgcagaaattggacatccctagagtgggaaaaaaaaagaacttcaacctaaatctcacaccttgtaaaaacttaattcaaaatagatcatggacttaaatgtaaaacataaaactatcaaaatttagggaaaaatgagaaaatcttcaggctctagggctagaattggcattgaaagcatgatccacacacagaaaaaaatcagttggactgcatcaagatttaaaacctttgcactgcaaaagacctgtgagggaggatgaaaagacaagctacagactgatagaaaatattttcaagccatatagccaaaagatggatgtctagaatatataaagaactctcaaaactgcaaggtaaaacaagaaacaaacaatgcaattaggaaatgggcaagacacatcaagaaacgtttcaccaaaaaggatatacagatagcaaataggtgcatgaaaagattatcaaaaacattagccattagagaaatgcaaattaaaattattatatattcctacacatctatcagaatggctaaaacaaagtagttacaacaccagatgctagcaaggatgtggagaaaatggatcattcacatattgctggtggaaatgtaaaatggtacagccactgtagcaaactgtttatcaattttctgtaaaactaaacatgcagctaccatacaacccagcaattgcactcttggacatttatcttacaacctgtacaaaaatattcataccaccattattcattatagccaaaaactggaaagaacccagacggtcaacaatgaatggttgtacaaactacggtacatccatacataccaggcaatactattcagcaataaaatggaatgaaatatttatacatgcaacaacttttagatcaatctccacagaattatgctgagtaaaaacagctcatctgaaaaggttacataatgaatgattctgtttatatagccgtcttgaagtgacagaattaaagaatgaagaacagattggtgattgcaaggagtccgggacaacaggggaaagagagagagagagatggatgtgactccaaaagggcaacacaggaggcatccttgtagtgttggaactgttctttaccttgattgtgtcaatgtcaatatcctggttatgatattgtactatatttttgcaaggttttaccttcagggagacggggtcaggggtatactggttttctctgtattatttctcacaactacatgtgaacatacaattatctcaaaactaaaagtgtaatttcaaaaaacaaataaaacaattcagaaattttaagacttcaacagtcatttatctcatttgttattttactgttgagaaaacaggcacaaagaaactgaagtgacttactttcatgcttcacctaagtctttttttcttttctccatcactcagttaagagcttctgtaatacagaaagtatgtcttgtattcttttaactcccatattacttcaagcaatgttgaacacatgttaacattgtaaaagttgttgtctgagtaaatgggaaagatagaggtctatgtctatatgcaaatactttgtattaacatgtttcagtctgatataactttccacacagaaagtacaaaagaagatctgttcaagttatctgatttaattaagatagtaaaaagaaagctgataatttagggggtcttatttgattgtttttaattttacttattttccactaggtgatcattttgatgattcaaaaatgaaaatttacaaaaaggtataaaataaaaattatttctcctacctctatgcactgtcgaatcaattcccctacccaccaccaatcagtattgtcagctgtttgtatatccttcaggagatatgtacgaatttcaagcgaatatgcataagtttatgttatgtatatgtgtgtgtctgttttctatatatatgcatctttacattaatggtagcatacgatacacattttcttctgaattatgcttctctctcaacaatgtttcttggacattttcctgtatcagtacataaagaatgtatttgtttcctatgactgcaatagtgaaataccacaaactggatgacttaaccaaaagaagtctgttgtcttacagttctggaggatagaagtctgagatcaaggtgtcaggagggttggttccttctgagggctcggaaggagaatctgttccattccattcccctagtttctgatggtttgttggcaatctttggtgctccttgtcctgtagatgtctgccttcattttcacatggcatgccccctgtgtacgtgtctgtctccaacttccccttttaaggacagagtcatattggactcaggcccaaccaaatgacctcattttaagttgattatctctgtaatgaccctatctccaaatagggtcacattctgaggtaccaggggttaggacttcaacatttaaatttggagaaaatttggacagaattcaacccatagcaaagaacttaaccgttagtttaatgactacatattgttccattttgtggatgtatcataatctatttaagcagtgctctgaacattttattggttttcactttcattgttttgccttaatattggtgtctgtttcatagaatagatttatagtattttaggcttatcaagattttatttaaatcttggaatttaaattccctgtaaatttcaagtgccttgaaggcaagatatattgaggaggggagacttttaaagttcatatgaaataataaataatcgcaagtatctcaggaatgcatgaaaaataataaatgtctctgcatcaataataagggagggggcttgccttatccaatattaaacttgctgtaaagctactgtaatccaaatagtatagtattagcacaaaacaagacaagtagatcactgaagcaaaattgagagtccagaagcagatcagattgtttttggaggccgggcatggtggcttacgcctgtaatcccagcactttgggagtctgaggtgggtggattacctgaggagttcaagaccagcctagccaacttggtgaaaccccgtctctactaaaaatacaaaaattagctgggcgtggtggtgggcgcctgtagtcccagctacttgggaggctgaggcaggagaatcgcttgaacccaggaggcggaggttgcagtgagccaagatcgcaccattgtactccagcctgggcaacaagagcgaaactccatctcaaaaaataaataaataaataaataaatagatacaaattgtttttggaaacattatatggcaaatgtgttattttaattcaaggaataaaggtgttttattcaataaatggtgccagcactctttgcaattcctcttagaaaacacagattgcctcctagcttatgcaatgtaagaatacatttcaaatgcattaaagttttaaatgtaaaaacaaaaattcttggaatgaggaagacgttttctaaacaagacacaaaactcaaaagctataaggaaaaaatataccttgttactgcttaaaataacagaagacaaagtcaaaagaaaaacagcaaatagagtagatgtattcgcaacatgtgacataaagagatgcatatacctaatatacaaatttctcctacaaatttgttaattaaattaatattttttaaaattcaaacaacccagtacaaaactggccgaagtataggaatatgcaattcccagaagaggatatccagatagctggaaaaataaaactatgataatatgcttcctcatagtagtaagggataggaaaataaagaaataagacaccatgtctatctaacaaatagacagaaattaagaatgataatttttaatggaagagagcactctcagatattgcagatgaaacgcaaattgctgtggtctttgaggaaagaaatgtggtatgatctacaaaaattttaaatgcacttaccttttgatcagtcactccatttctgagaatcaatactacagaaataaaagtaccagtatgaaaggctgtatgtagaggatgtgtattttggcattgtctatgatggtcaaaaagtagaaatcaagcaaatacccttcagtgtggaaattattgaatatgttatggaattatttgggcatcccagaatgaattattatttagtctagttagagctgtgtctactgtcctgaaagaatggtgatgatatctttcaaaaatcaaaacaagtttcaattaacatattccatttttaaaataaaaaagataaaattaatcttatgggattacataaccatgaaggaggaatggagagatatatactaggttatcagtatttgttaccttggattttcaaaggagaatgaaagaggaacaaataatgtatcaagtttcacaaaaagtgaaaaggtggaatataaatattactgcaaatatataaccattgaatatgtatatggacaaggacgataagataatatagaaaactgaatatgttggttttattatgaggtggttggattgaagatatttttgtctccaaatactgttgttttaatatgttgtgttttacaaagaaacatgggctgagcagacagggaagccctgataagcatagtacctgccatgtggccattcaataaatgatagttattgattattattattagagttgtagtacagtagtgcctaccttaatatatttagattgatgcccagcagcattgagttaacccgcattttaaggacaagtgttatagctattatatactaatggtaaacttgagtctgtaactagcactgttgaaggaggacaacagagtaatatgatgtgtattggcctggggatggaagggtggtgcttaaggcacagcagattttcactccagccaggtttccttaggacctctccaatgaacaggatacctcccttcctgttctttctaccctcccaccccgttttttgctttttcagtttcagcccaaaggggaaggaagtatgatgactgactccccatcagtccctgaggtgaactgggattttgggagagtgtggcagctgcaaatttggcttcctggagataggatttttgccctcaatctggagaaagttcctgaggctacagctgttcaagcttgtgaagtaggaactttgatcccttttttcaaaagttttgtataattagcatccaacttgttagacagtatgtggctcattacaagattgccacaaattcatgctgggccgtgtctaagaacagggcaaagggagcctttggaaagtgttatacagttgaccctcaaacaatgtgagggttaggggcgctgagcccaacacattgaaaaatctaagtagaacttttcactcccccaaaacgtaactactaataggctactgttgacagaagccatactgataacataaagagtgattagcgtatactttgcattgttatatgtaatatatactgtattcttgcaataaagtaagttagagaaaatacgatgttactaagaaaatcataaggaagagaaaaatatatttactattaattaagtggaagtggatcatcatataggtcttcattctcattatcttcacgttaagtaggctgaggaggtggagggagaggaggggttggtcttgctgccaatctaaatgctgggcccagccaatgggtataagttttaagtgtgcacatattggtgaacccttacagatcacggcactgtctgttcgagtgtctattttgaaatgtccctatccgtaatataagttgcaaaggagtttgtgggcccactgaattctaccaccctgatcattgtgaagcccattcagctttgtgaagagcttatcttggtactaccttagccaaggtatgataactcagacataatgtcttttctttcatggttccttttttagtgatcatagattcagttctgtaataattagagatttatgtgtcctattagtaattgcatcattctttaaagacagtgtcaaccttgctatacagtgtgattgaagccttgacataacttgggggtttgttggcattttgaaatcccaggccccacttcaaaactgttgaatcagaatctgcattgtaagaagatccccaaaagatctgcatgcacaagccttgaaagagaagagaagccatctaacattcctcacctaagatttgaagaatttcccacttatgcaagagtaggggtgtgatttctcaggcaggatatctaacagaaaacaacacttatgaagtgtttcctgtaggagctaagcaggtggccagaaaatggcaggctacaaaggagaagaatgactaggaacctgagcaaggagaaagtctcaaagacaaggaagtggctggcagtgtcagggactaccaggcagctgaaaaagctaggtgtgaacactatttcttggagttttcagcaagtaagaggttcatgatgatgcctcaaagaatttacagtggaaccagagccaagaagtcttattgtggtgagttgggaattagggaaagtgttatacagttgaccctcaaacagtgtgagggttcggggcgctgagccctaacctcaagtaagaggttcatgatgatgcaatcaaagaatttacactggaaccagagccaagaagtctttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccagctaatttttgtatttttagtagagacggggtttcaccgtgttagccaggatggtctcgatctcctgacctcgtgatccgcccgtctcggcctcccaaagtgctgggattacaggcgtgagccaccgcgcccggcagccaagaagtcttatggtggtgagttgagaagtagggaggtggaaataaggaatggagatgaagacatgaaaggaatttgagaaatgaggcaatagctagagaagaatataggaatacacagatccagcaacccagcaagggaagggctagattctgatttcatgagcaaattgcctactaattaaattcacaatatcagaggaaactgttggactcacttactgaataatagctgaaaagtatctttgctttatagagagatcactgtagatgaaagtcatcttccagtggtgagatattcttcagtgtcatctcttcatttttatttctaatttttcttaatttgaattatttcttctgataatgggaatgatgtggtaattttgtctctcctgtaaattattttaaagatttgtacgaactcctttggcaggcttgagtgtgttgtgacagcttggcttagatatgcattgaatgtcattgaattcaaactccttaccaacatagttagatagcccataggcattctacttgaccctttcaaggagatctggagatgcaattgtaggggaaaaaagaagaaaagaattcaagaagcaacaaagtgaaagataatttggcttgcagaagagaggtctttctatcacagtaataataatgccaattatatgtccatatatatatatacgcacacatatatatagtatatatatatacacatataactcagacataattctttcatagttctttcttttgtgcacagattcacttctgttataattacatacttatgtgacctatttgttagtaattgcttcagtttcttaaaagagcatcaccttgctgtgcaaagtgtgattgaagcctcaacatctcttgggagtttttttagaattttgaaatcccaggccccacttcagaactgttgaatcagaatccgccattgtaagacaatccccaagggatctgcacgcacgttgcagcttgagaagcactgcagtatcacacatatacacacatattcaacaccaaagagagagaaagaggtcataagctctcaggtggagactagttccatgtatatatgcatagagagaagaacaaactctaccttccagcaacgtaaaattctactcaatcatgtattcaccaaaaaagaaaaggctttctccatataatgtgtattattcatatattggcactcttcagagctcttcattccaccctaatgttatctttcttagataattcacatgacactttgttatcttccaataatttctgtcattgttataagcgaaattattcaggctttatctaagagagtaaatcaaacagtatgcctctctcattccaattctgcaatattttcattctagaatgtctaaaggagccttgaaagagaggagaagtcacctaaggccagctagaggggatatatagcagggaatggtggcaactccactcctcgtagcccagtggggttttttttttttccaatctgtatttgtatgtgagtatcacgtctatgccgattttatgtgtacatatgtaactcaaatctgttcattgtgctagttagaatcttatttccccctcttctactacactctaccctttctctttcccctcctttggcaaccaagacactgagttattaataagcagattggagcaaacattttgatgcactattgtttgatagatttgttggttcattcaataagcattaattgagcacttgctaagtgttaaacaatgtactaattgctagatttaaggatgaaaatgataaaacccttggcctctagagcctagagtgtagttggggagacaaatgggcaaattagtcacacgacaacatattccttgttaaaacagacagttgtgcataagtctgtatacccagactggagatgactctgtttccaatgttgccctgggaaacctcatgatcagtttaataatgatgtttggggtgagaggatactgagacagtttgcttctagcatagtaattacccatagaagtttggggtctttattcaaaagagtttacaggccacatgagccactgtcttgccttttataggatcacatctaagttccgtgtcatataatggccttggccttcttggctttctctgtgctctttgcctgccaataccctaattattgaagtactgtctcccgcagctcctcaaccatgagctgttcccgatcctcccagcagctatgtttctcctttcttcaaacctctttagctttttatttgtactttatttgtactaaattgtatttagagctttggagaacattcttcatagttgtaattagactgtaaagtcctgagaatgtatttttcatcttcgtagccccctgcagtatctagcagaatgcctttaaacaaatgggcagtaaataaatcccaacaaacttaaattaaatttctccaaattgcatatttaattttatagtggcatttactgataacatacattgaaataaaggccagagcataatcctctctgtttctgaatattatttatttaaatattaactttctaatccaattaggtctttcaatgacactttagatctaaatttatttttgcattgttttaaatgtcatcaaatgattcatctcttgtgttttttaatatttttggaacgaacgtgtgaaaatgagcaagtgtcatcagaatatgatgcttgggtttttttaattcaacatttctttgatcatatatttaaagactttttctcaattcctttctggatgtggcctcacaaatcatttcagaagtcaatccatttcaagatttttttttttttttttgcttttttcacttcacaggaagtcaagttcattctttaaaatgtagcaaatgattaagcaaattcaacgaatgatcttcatcaactccgaggtgtttttcccccttgaaaaatttaagttactattatttttttttctttttttttttttttgatacagagtctcactctgttacccaggctagagtgcagtggtgtgatctcggctcactgcaagctccacctcctgggttcacgccattctcctgcctcagcctcccgagcagctggtaccacaggcgcctgccaccatgtctggctaattttgtgcatttttagtagagatggggtttctccttgttagccaggatggtctcgatctcctgacctcgtgatccacccacctcggcctcccaaagtgctgggattacaggcgtgagccactgcgcccggccaattattattattttttttaaacttcacctatcataaatcttttaaaatttcacctatgataaacttcctctgtcatctggggaattacttaaatgcaatgatggccttcaagtatactaccaggcagcctatccaaatcatgaaacagaaaggctcatagaccaaattaaaatacttgaatcacagagtttattaaaatcacagtgagaagcaaacgggaaagatatgtgctaagttaacacgcttagaatagagtgtaagcagactgtgaagattagagtacttgaattctgcagtacacaacattatatgtcttgtctgtctctgtattgcatcagccttcccaattatggtgtgcttacaaggaccaaagttgacttcccaacaagggagtccaaaatgggtggtgcctgattcagtggcatgtggtttatcagagacacagagacaagaatgcatggccacagctgtaacttgccaaaatagcctgatgactagccatgtaattctcaggcagaagacttacggtgctggaataggtatcacctatggatgcctgaattaagaccttgtgaacattaagtgctcatgtgtatttatttgatcttgaatatttagtgcctcttgtatatttggtctcatgtgtatttagcatattatgaatatttagtacccaggtgcctcatgaatattgggtatcttttggtccttctatccctcactatctatgtttagtacacacatgctctgcttgctaactacttatcttctaattaacacattccaagagccaattatgtgtatctctttccactgagttcttcattcaatgacatcaagttagttgcttgaaatcagctattgtgagagcacttacaccacagaaattggcaaatgctacaattagcgccactgccctcccctagagccagttatttgacatttactagcattccactacttacatggcccttcatgctctcactccgtgtgaccactcaagccttatccctctttactgaactctacaatcaaataaaatatctttgtttcttgcttctggccctccatcaaatggctccctctcctaggaacaatctgtctctcctctatcacctttgtttagctagttaataatcccttttcagacagcacctcataaatagattcctgaacatcccaaaccggatctcctgcaccttcaatgtgctacttcagtacatttgtcttaccctttgccatatggtatttcaattgcccatgaatttgtattcctgtttagatcttaagctttgtgaggtctttttgtacttttttgtacttccgtatacctaccacataataaatatttaatgaaagcattaatgaataagtaagtgaatggagtgagtgaatgagtattcaattatgattcatttgtatcaaagtgataacatatacttacagggaaaaggccagagggggaaaaaataaaaaataataatatattttatgtatgaccttgtgtggggaaaggaacatagggccactgcctggcctgcttcttttatgcaaatcctaatgtaaaatatgatcaacgcctggctgggcagaaatacaaaaacccagtactagtgattctcccaaccagataccagctagtacagatcatagccagatttaactactgtgaagtggttaggttagaggtgacctataaggaaatgacgctaatgatcattagcatcatcttggaagcttaaaaaaatgccccagctgtaccccaagccaatgatatcagacttttgtggggaacccagatatcattgtttttaatctttaatgattccaatttagccaaagttgagtctcaacaaaccaagttcttcttactctcatattctcttcttctcgcatagataagaattaacagccagctcttctacatgtttcttagacacatatattgtttcagtggtaattcgttaacagtgcatatgtcagcaaagcatgactgaaaaaaatatctgctcccacacattctgatcccatcttgacactgcatagctgttggcgaaggcaatttcaacaatgaagaagtgggagaaatgactacattttatgtaaatatgtattcattgaaaatcaaaaggacatatgtaatgatattgtttaagattctaaatgaaggacaatacttaagagtcctctgtagtcaaatttctcagcagtaaaaaaacattgtcttttctttacaactattaaccatatggctgtgaaaatgttattctacaagcctttaagatttgaaatctgactttatgttaatacacagaatttaccacacaatcctgtatgatttctaagtagatttaaagagtagctattgctcaccttttcaacataatggtaatgatggtgcaatgtcaattacatgatactctcatgggcgtgattatatgattgttaacacactgaagtgcttatatagacatagatactgatttttatatgtacatatttaaaacaaacaaggacttaaaatggcctgtaaaagtctttctagtcagtctttctggttttggacagagaacaaataatcccttacagctgttaggttggtgcaaaagtaattgtggtctttgccattgcttttaatggtaaaaaaaacgcaattacttttgcaccaacctaatagttatctacttccatctttaacgggccctacccaagactgcatggtatataagtaagaaatgtaaatgaaaatctcaaatgctagatctgcccaggaggggaccactaatgagagaggaaatgttaacgtcccatatgaactaagctcagcttagcatttacccttcctgctattccgctagagcagtgcttctcaaaagttgacctgtaatggaatcttctgaatgcctttttaaaacgtagctggctgggccccatccccagagtttctgtgtcagttggtctgggatggggcctgagaatttgcatctctaacaagttctcaggggatgttgccggcccttgaatcacaacttaaaaacctctgctctgaagaaagggaaagctctctctgctggatttccccaagcctttttcagattttcaggagacttctgtgcggtagcttgcttccttctttccatactactactactaccactactactactacaaatagcaacctctagcatattttcagtactaaatacccagcactatatatacatcacaaaagtcccttgaggaaggtggtattatcatctccattctgcggataaggaaatagataagaaatttgctgaagatcgcagagccaaatgagactcaaacccatgtaacccatgtctgtttgactttaaagcccggaatcttaatttgttccagacaagctcattatgtgctctgatcttcaccactgaaatgttctgaatatgaggctgagggcagcagtgaggttggaaggagcagcccagaggagcaggcactgtgctggtagaatagtagtatggtggggcctgcactccctaataaaagaaggggacaatgactatttcctccttctccaaggtcgtgctgcctcccatttctctgtctgcctggtaagaagcagctctgggccatgtgtggtggctcacacttgtaatcccagtgctttgggaggctgaggcgggaggatctcttgagcccaggaaattaagaccaaccctagcaatctagtgggacttcatctctaataaaaataaaaaacttagctgggtgtggtggcacacacctataatcccaactactcaggaggctgaggtgggaggattgcttgagcttgggaagtcgaagctgcagtgagccgtggtctcaccactgcactccagcttgggcagcagggtgagaccctgtctccagaaaaacaaaaagcagcagctctgaaaagaggatctagcagtttctatatgcaggagagcatttgcgcaattgttcctggggttgaatctgagaaactcacagtgcacattcagatactatttacaatcttctaggaatagtataaatattgtggccagggcaccttcatattgtgaaacacaaaaagacttcagaccttagattatgtgtcgaaagttaggcaccaatgatttttttttccatttgttcttaagtggcaaatctttacattaacatttttggtacttgtctttagggaaatttcttctctgttctgaatgtatatattgtaattcctcatttacaattttgcctgcaaatgcaagtgagtacagatcatccagttatgaaaatgctctgagatttgagtctagctgtttcagctttaagagccctgacctagactttgaaactgacatggttttatatgtatgtggttggaattaaacccaaagcacatcttttaaaactctgaggaacttctgtgccacagctttcgctcagttggtgagattttactttgaaatttaagggatgagtctagtttatatgcaaagaaatgtagggagctttgcaaacccaatcaaatcctttgtgaacagtgtgtgcatctgtttattttgctgtcattttgagtccatgatcctgtatactgttttgtgggcacatattgagggtaatatcaaataccatgtagaacagatgctgcaggtatcctttccatgtcctcttagctttggggtggtagatgggcacatggaccaagcccaaagtgacagggtattaacaggagcaagactcaaccaataagggagagtagatgggtacaaatctcagctttctctcccctcactgggataattttgagatatattccaaagatcctcagagcatccccaacagcattgagccccagttccccagattagtaatctactcaataaatacctcttttttttttttttttcccgagatggagtctcactctgcaccctggctggagtgcagtggcacaatctcagctcactgcaacctccacctcccgagttcaagtgattctcctgcctcagcctcttgagtagctgggactacaggcatgcgccaccacacccaactaatttttgtatttttagtagagatggggtttcaccatttggccaggctggtctagaactcctgatctcaagtgatccgcccgccttggcctcccaaagtcctgggattacaggcatgagccaccacgcccagcccaataaagaactctggattgtttcttccttttcctctcctcctttcctgttccctacagtgtttcctaggatcacctcagtctgctgtatgggaaacccagactgagtcaccataacagacagaggcattgttactttaggactttagtggatatagttacatgggagagagagactgtgtatgtatatataacctttataatattaaaccatgctatactcaaattatttactggccaagatttccaatataaattggaaataaattggatataaatcaagaacagttaaaattggaaatagttaaaatacaaataaaatagctaaaattgggcaaaatacctgacccaatgctttaatatccgattgcataattaaacgagtaaagaggaaaggaaattattagcaactctatatttaaatgcaactgacatccaaggaagtcatgaagaaaactctttgtgttgataaactgaaggcctcttctagcagacttctgtgtttattgttctgttgctgactattttattccaaacaaatgaacttgcttgtcattataccccacccttccctagtacagggcccccattctttgaaacagtaactcattcagttccaaggagaatatgaaaagggagggtaatatataaaagaactgaaatgaaaagtggcctaagtgtggcacatttccattgtggattccatggcaatggagaattgatggcagagcatggtgagagatgtgaagcatcaattggctgtatctccagggaattcctgaagttcagttgccaccctggagggtggcaaatgctctctctcaccttccttgagttattgcttagatgactcaaaacaaaaaactgatgagctataaatgggctgtattatttgtttttacctgctgagtagttcagatatttcaaaataatctcaaacttaacctatggtgtggtttctgtgttaaacaaaataccgtaacttttagttgaaaatactgtgtaagcccacacaatctcttgttcacagataatcttgttgtcaaacattcatgatgacaaaaactcataaacgattcttttaaatatcaagaataacttatgctgtaagtcataatttcataagcatgaatttatgaatgtgttttgtgtttgcaattttcatttaggttgtcttaaaatcatgcgttttagcttaacttaggagaaatatatcttttgtgacaacataggatattcagagaaacgtgaaaactaggtgatgtgttttatgaaagaaggcataaagtatatcaagcataagaactttgaattctatttgtgttttttgtggctttagaaaagattgttctgggaatagagaattccatttgggaaacctagcacatacacagtagcagagttaaaatactgacttggagggttcatttgaagaattctatagaatttttgcatgttgggaataggtttatattcttaaacattgcactcagggtttctattcaaagcaaaaataactttgcatagaccttggccattctttcacattctaaagtaatccatttttttttttcagggtagttgttctcagtcctgattttctgataattcagatcatctttaatttacaccaaaaacttttagaagagtcagataataatttaacataaaatgtaaatgactgaaatatacattttttaaaggagcagatatggaggggtccaatgtacttaactatttgctctctttgtctccttgcattcacgggaatgtttctatgtagttttctaatttcacacaatttcaataatccataccctcctcatttttatgggccttcatgatactaaaaatgttaccagaaattattttgtgttagtctctttgtttagcacattcatacataagttttaacatttaactggcatatttttaaagtaatacatgttttttttttaaaaaaaatcagttatgtttgtgtgtgtgcatattttcttttgtggccaaatgttgcacgccctagtccttctatttaaacaatgagtttacataacaaatgttacatgataaacatgaagacatttagtttgaaaaaaaatgattttctagtttactcatttaaaaaaagctgaagtaaccgggaagaggagtggcagaacatattagtctttttcataatgccatcattaaacaaagatacttaatttccaggcctggtgcagtggcgcagcctgtaatcccagtactttgggaggctgaggagggcagatcacttgaggtcaggagttcgagaccagctttgccaatatggtgaaaccctgtctcaaaaaaaaaaaaaaaagaaaaagaaaaagctacataatttccaaaatgacttcagtgggacctgaggtgagggaataaaggctctggagtaatttcactctctattcctctcctaattttttttctgttcctttataacaacattttcactacttttgagcttgggagttgaggaatcatgaccagaagaaaaggaaagacgggaaagatgttcaagggtgaggatgcttaagaatgacctggcaagcttatgaaaatgcagttgtctggatcccaccacagagattctgatttagcaggtctgtggcaaggcctgcgattctgcattgctaaccagctcccaggtgatgacactcatgctggcaacctatgaaccattgagtggcactgttccagggggcagggcaatgagaaattgaagtcaaaagccccaagacctggtgctacgaaaatactctggttccttccctctcaactgatttacttgtcggtgtgattttgcaaaaatccctgaacttcttaaatcccagttacctcacctgaaaagtatgagtgttgctccagatctggaggctttcagaccatgcaaatcgaattcaaaccatgcaaaccattcaagtcattctagaaagttctgcaaggtgcctcagaggccaaagggagagatgggaagagggattgaatgggctctttccaaggttccctaacccacttgaatactttcatcttttatctctttcatatattccacttttgagtatggtttcatttagaaaataggattttataccaacagatttaaagaaaaactccaagtctgaaaatgactcatttatttaaaactgtatagaacaaagacatttagtgcacaattccaaaaattctctgatccttccacagcatgcccagtatgctgcaagagtgccagcaaacacatgcttactgctcacaaatgtgaaatttaaccccatgcactaggaggtccctagtgtggggtggttttagctaaccagactaagagagtacagggcaacatcgagcctttctctgcggtcatgtctgattcattaaaaatccagctttccccgaagatatattaattaccttctgtttcagaatttgtttttagagcctaattcttaattatatctccagccattgtgtgatttgaccattttggaactaaaaagttatcctatgaaattccacctccaactattgccacactgttagtttgtctatttcatacaccatgccaatcttagcgtggtgctagcatttcattataaccagctttcatttttaataagaccatgtgtatatgaaattgtagacttcagtctttgtatgaattgaaagctattaatcttcccagggttaggttatgttaaacagattgtaatgttcttctttttattatgttatttaaatccccttcatttcatactgcaccaatacatttctactatcttggaataaattaattccagttacgtgatggaaaattttagtgtaaaaatataacctgcagtataattttttctgtcagaataccaactagaactggtatgtttcattctaattggaaatttgagttatcgctttgatttttaacagtgggaaaggaaaatgaagattgatatctttcaatagccgttcattcattcttcattccttcattcattcacgtattaagaatagtctatgtgctaagaacagaaagagtgttagagatatgaagattaataagaccagatccctgcctgcaggcatttcctattctatgtcatagatagggggctattctgtttagaggtaaagcatgacccacattgcctctgacaagaagcataatgtctgtagcagctaactgctggagacaggaggctagagggctgccctggtaattggtattcaagtcttcaagaaaggaaaccagctattccaaaatcagtgggcaagaggaagttgtaaagttaagtgaaatgactaaaatatgaataactaaaggttggaatctggtagaaggagaggagagcatcggtcagcaccttagtttgggaaggtggtgtggccatagtaggctttatttagaaagaagcaattcttaggtaccagctaggtttcagttccttaaggggagaaaactggcaaaatataggcaggtttccagggtgcaaagccacgttctagcttcagctcaggcaaggccctggggtatgaatcaccaccagagtagcccagccaaaatgactaagggatctaagctggttgctaatgaaagaggttgcagctcaaggcagctctgctgacgcccactggatactgggattacattgatttaacacatggaaaccacttaatatggtatgtggcacaacacaattaagtactcataaatatttgcagataatgctgctgccattgctgtttttgtcgttagaagactcgggaaaatcatctaatacaggaatccatctgttggcggggcttgggcttctaatatttgactggttgatttttgtcgacccaatcttaacaatattatacacagccattacttcaggaaaggcagttgtaaagaatggtataaatttcctgtaacttgactgccacattctagctgagtcacctctatatacctcagtttctttgtatccgcagtgaagattaatgacctcatagggttgttattagaatgaagtgaattactacactggacttatttaggacagtaactcgcacatagtgagtgctcaaggaaatctcagaccctgcctgctagtggagggtccagctcctgatacatttgggggcaggtttaaggagttcattgatttagagctgtaagggctgatctttcaccctgcatgtcttcagcaactgtggctggtaaagtccagagcagtcaaaggctgacaaatccttgttagaaatcacaaatgcccattctcacaacttctgtggtgttttccatcctttccctagaatactttctttttaaggcaaaggaaagaataatcactgcagatagcacacagtatttttttgcaacatattttcaaaaattatgatgagaaaagtgtatcattcctgtgaagaaacagcataaggaaaatgatttgagaaagaaacatggttcttaaactgaaacaagtgtcagaaggaatcccagaaggcagaaggaaatatagtaatcatgatgaagtctagagctcacaccggttaacagaatggcagcagcgatattcatctcacgcctcttccatgctgtccctgagtgagcttctgctgaattgcctggctggtgaggattggtttcagcagcagaaggaatgggctgccagctgaaggctctggttctgatcctgggtagggtcagagaaagcaagatgtgaccatcacttttgaccttggtcttgaatttgattccatggaacaacgatattttacaaacccagttgaaggtttatccctttttctattcaacacagggagagtccttagagccccaggaagacttagccctttttcattctaagagtaaaccacatctaggtttccagagatgaaaagaccaggctctgatcttccttctggaagcccttgcctattcaacaagcatgagtattaaatgctattgccttggaatcataattcagttttcacagtttgggctatgtcagaaccattcttgtcaaccccctgttttctgagaacccgaaacctgcttgtttagaattttagaatctacttgactcttacaggggagaaaagatctcttttctcacccatcgctaggttcatggctgaggcacctataatgaaggacaaatcaacaacataaaagcatgcgaatttatttaatataagtttcacatgacacaggagccttcagaaatgacccaaagaatcagggaaaagtgtgtatttttatgctctgatttgaggaaaagtagatgtccagtatgactggacaaaggggaatggtaataaactggggtgaccacagcaaggcctgtttctgcagaacctcctgtgtccctgtgttttcagaggtaaaaattttcctttccttccagtatagtaagggcacctctggtatgatagtctcatgacctgcttcaggggagaagggggaaggggaaggtgagagtgaccatcctgcttctgctgtcttctcaaataccaagctgccatattgtggattttggagtagcgtaacttgaatccttttttttttttttttttgagacggagtctcaccctgtaacccaggctggagtgcaatggcacaatctcggctcactacaacctccacctcccaagttcaagtgattctcctgcctcagcctcccgagtaactgggattacaggcacatgccaccatgcctggcaaattttttgtatctttagtagagatggggtttcaccatgttagccggactggtcttgaactcctgacctcgtggtccgcccacttcggcctcccaaagtgctgagccaccgcacccagccgcatagcttgaatcttatcaataccttaaccaaatgactctgacagttttcctcttcttatctaaattcttgagggtcacccacacttcccaatgtcttttgaaacttgacctcttttctgctgaattgaggaagatacctgatttctttaacctcaccaaattcctacttcttactgttgttcattgctggctgaaaatttactttggcgagttcaccaagaacatacttatcggttcactgtttatatttgcactcaagataacacttgaggccctgctactcaaagaatttagtgacaactttcttcatcactctcatatcttatctgtcatcaagtctttttttcctcgtaaaaatgcttttagctctttaagtatgtttcatatctataatagctaagataggctaacagctataatatattaaacatccaccaaatggactattaaaatgacttaaacaaaatagaaatgtatttctttctcatgtaaacagtctaaggtgaattcatgttagttggtgttggatgtgtgtgtgggaagggaggggtgacacccacataattattcaagaatacaggccaggccaggtgcagtggctcacacctgtaatcccagcactttgggaggccaaggtgggcggatcacctgaggtcaggagctcgagaccatcctggccaacatgatgaaaccccatctctactaaaaatacaaaaaatagctaggagtggtggtgggcacctgtaatcccagctacttgggaggctgaagcaggagaatcacttgaagccgggaggcggaggttgcagtgagacaagatcatgccactgcactccagcctggcgacagagcaagactctatctaaaaaaaataaaataaaataaaaataaaaaataaaaaataaattaaaaaaaaaacaggccagcaagggtcttccatctgcaatagccaattgccgaggttgccctcctgaagatattcagccagcccaaaggggaatgagctagaggactgcacacggaggcgtcccatgtcctttgactcaaccttctactggctagaactctgccctgtggccacatgtaacagcagaggggctggaaaatgaagtctagctagatacctaaaaagaagcagagaaaggtttcaagagcatttagcaaccatatccaccttattcatgccctgccctctattcgcagtggccccgcagcactgctcaactagcttgctgcattggcctcttatctcttatctattgccttagatccatctaaatgctctgctactcttatgcctggaatatgttttcaagatgtgactaatcctctcacagcttgaaggataaaaggtcaaactgctctggtgaatgcatgatgcctggtcacctctgtagccccatcttccctgacactttcacagacagtattccctttactccaacctgtgggagtattttctaattcacaataatagcaggaaatacaatgtggaccagacacagttctgagcagtatattaactcatgcatttcttacgataactttataaggttgacagtagtagtatccctatttcacagagaaggaaagagatacagataagtaatttacatatgatctcacagatagtaagtggtacagcttgagtgcatatgactcaaagggtagaggttctagattcttaatcactgtattgtactacttctcccaatgttatcgtacatgccattccgtcttcctggaatacccttcgtctttcttcatctaacttccactcaaactttaaggatcaatttaagcatgccttattttaggtagccatggttgacatcagcctaatttaattgctactcatctatgtccccatagcgtcctttgcattcctctatatctctctgctatagcagtaaatgtaccaccattccgtaaaatccttaagggaatgtttagttttatgttcccaatgccagcacaatgtccagaacagtgttgtcccatagaaatgagagccacctatgtaatcttaagtattctagtagccacgttctttaaaagtagaagtgaaactaatattttattgaccctgatatatccaacatattattatttcaatatgtaatcaataaaaagtattaataaaatttgctttttccattctaagtctttgaaatctggcatgtgtctttcaattgcatcccatctcaatttggacaccgtattttcattgaaaatatttggtctcacctgcacacgtatgtttattgcggcactatttacagtagcaaagacttggaaccaacccaaatgtccatcaatgatagaccggattaagaaaatgtggcacatatatatcatggaatactatgcagccataaagaggatgagttcaagtcctttgtagggacgtggatgaagctggaaaccatcattctgagcaaactatcacaaggacagaaaaccaaacaccacatgttcttactcacaggcgggaattgagcaatgagaacacttggacacagggtggggaacatcacacaccagggcctgtcgtggggtggggggaggggggagggatagcgttaggagatatacctaatgtaaatgacgagttaatgggtgcagcacaccaacatggcacatgtatacatatgtaacaaacccgcacgttgtgcacatgtgccctagaacttaaagtataataaaaaaaaaagaaaatatttggtctctatttacatttcataaactttatagttgaaaaaagaagattcacattcctaagttgttccaaacatacacaaaagtttttcaataactgaaccaagagtcaatttttaaatttatatttaaatttaataaaatggaataaaaatttgttaaacttcagtctctccgtctcactagcctgatttcaattgctcggtagctacctacagccagtggctcctgtgttagacagagcagcacagccctagaacacagtagatcctaaatcgatgtttattgaagaaattaatcaatgacagtgtagaaaatttgcagtgattatgtcagaatcaatagttctccacccattttctcccacactctcaaaagggccaagttttatatcaccaaatgatattcctcttacttctttctgagcagaaacagttttggaaattaagatctttttcaaattttccagactcggcattttagcagcgtttctatttgtaccaacaatgcctttctacctattttccttgcttcttaataagttaactttgtgcgaaggtcattttgtaggtcagtgtaatattgtgcattaagggcttctaagttttctggtattataagaactccttggtttccttctacttttcagaatggaaaatcctcagagcaattttcatctaaaagtgctgcatttaggttgtttcacaattccccaaccctgagtcaaatataggttggtgtatgagcagcagtgtctcttggctaatcaagagcgtctccttttgctacgctcagtgttagagaaatggagaaagtcagctgggtttagagattaggtgagagactcaggcatatcctttgataagtcataaatcatttcctgtttagaaaagcacatgtttagacacccataaaatctccaaatgaagggtgttttacttttccttcaaaatctcactgggaaaaggtacttctgactttccaagtgaataaaaataatgactcctgattaccatgtatgtttaaactgatttgcaaagcaagtgaaaaagagtctagtgagtagtgataagcatcttttagacatcagaagatgtactgatttaaaggtccgtatcattttataactagtatctattgagattcaaatggttattactctgtgtgaatctgtcttttctaattgtttttacttattttagaatatcgatttgtgaatattaaattcctaagttttccagcaatccagtgtttgttttggatatccagcctggatgcagaatagctgcagaaagttatcacaaattgatctctatattctgtttccgagtggcaattgtcaaaaatttggggtcatcggctacccctcccacccctaagaagttccttgtacttcctctttcaaaacactcacatcattgttcagtgcctcacttctctactaaaatgtaaccaaccacaaagatagggactatgtctttcctgtttactggtggattctcagtatctagcaccatgaccaatgttaatagacgttgaatcaattccagttgttacctcttcacactgggacaaaagtccttgcaagtattctgctgccatttgtatagattcaagccaaatatgtctcaaaacgatattacagatgatctcttcgttgttcctctgacaatttctttcccccctgcattgcttaacttgattgacaatgacccctactacttataacatgtgccttttaggtagtgcacttggcactacattttatgtgatagttttatgatgctaaagactatttgctgtgatgatgctgtgttctcacatggcatatccagatttatttatgctggtgaccaaaggcaggtagttaaccttgaaaataggttaaaatttgaaaggcagcaaatcttagggctagaatttataatttatctttaaggaatcttgaaaccaggtgtgaaggaagggacgtaggctagaagtacagaaacctgggttctgctccagcactgatgttaagagcaagttgcattgcttttctggaccttaattttctcttctggaaaatgaatagattaactggaacaaggaaggaaaatacgtgaatggcttccgtttctgtctcgtttacccctgaaagacatggctagtcagtcagctctgtatcagagcacttctcaaggcaatgctccaggtagctaccactcactaatgagagttagcacataggtaaaacctctttgtcatctctaggctacttcatgtttaagatactctccagctttaaaattctaataactctattagactgaaatttaagaatacgagaataatcatccctcaccatgaagagagagtctgaggaaaaaataatgagaacgaataacccttctcttttactacaattcaggactgccatgaagagccgtccagattgtgaaacatacaactcatgatgtgaatggtacttctttgtttttctcggtgtacaacttgcacagctgttcatggccctctgcttccacaaattcatttctaaatagctgtacctcagttctttgacttctagtatgtctaatttaatacacatttctagatttacgatatataagaaatatctccatgaaggaaaaatgtaatagcccatgcttttcattataatagaattttatgaaacaatgtcttttaaaaacagaaacatatgtactactacttcgcaggacattagcccttgtatataaatcaataatacaaaaaattcaaattaccaaggattagaaaagactgctgtgggatatcttctggtgcaagcatacagttatttatccatttctttcatgaatatttattgatgttccaaacattaggctagacactagagacacatcaataaataaaggaaataggtttgatctctatcttctttgatctgtagtttagtgggggaggaaggaaattaaacaagtaactactacaggttgaacatccctgatccaaaaacctgaaatccaaatgttccaaattccaaaactgtttgaatgctgacatgacatcacaaatggaaaactccacttctgacctcatgtgacaagtcacagtgaaaatgcaggcacaccacatagagtttattcagcatccccaagggaagaaagatcctctcagcccccgttagctgtgatatatcttttccacccacacccagattccatcatacaagcaaacccacaaaaggtacgaaaaatggcacatgtgcgggctagacgcgacaacggcaggtaccctacaatgtccagcatggggccaaaacctacgtgcattaatcactgtgtttgctggtatattctctggtggtgtcaagatattgttgaaaatgccctaaaggcctgcatgatatccatagggtaatgcaaatattccaaaacctgaaatttgaaatactttcagtcgcaagtattttggatatgagatattcaacctatagatggtaagggtattactatgatagtgctacgggtgtacatcaaggtaattgaccctggcttggcaggatgcagaaggctttcccaaggaagccttacctcagctgagacctgaagagaagcaggagttagacaggtcaagttggggatttggaggaggtggagtcccagcagatggaatactatgcataaaggcctggaagtgagaaagtcatgtcatgttatttcaagggactagaggaagcttagcaaactggaggcaagaagatagcttcagcacactattgaaattgtccaggtgagtaatgatgatagtgtaactaagttgtgatacctaggtatgtgagctgaacctatggagaaatgttctaggctagagaatctttaattggatatttaattatcagtatatacgtaattaaaaccttgcaagggtttgaaatggttcagagtaaagttcgtagatgagaagagggcctaggagtgaacccaggaaaatggcaaagtttcaggggtaaataaagaaaaataagctttcagtggagacagggaaatttgcagttcagtagataggagacagactaggttcgtgtgatgtcacagaatccaagggaagagaggttttcaagaaaaagtaacatttagaggtgtcaaatactacaaaagcatcatgaaagataagaccaaaatatatcctattaatttagcaacaaggaaggtattgacaacctttatgcaagtgatttcagtgttgattatggagaactcagtaattacttggtggtaactaaagaaccaagattgcagtacgttcaggcatgattgagaattgagaaagtgggggagcaagtgtaaaacaattattttaagacttttggctgcgatgggaagagagaaagggccatagtagcagaagatggatgtaggggcaggaagaacacactcttaaaagggtagtgacttacacatgtttaaatggcaatgagaagaagatggtagagagggagaggttgaggatgcaggagaaattagagataatcaatagcacaggtacttgagaaggcagaaagatgaaatttagaaattagcttcagataggaaggaaagtacagcttctattacaacatcaggggagaagggaaggaggatgggcatagctactggtagttttgtaagtttggtgaaaggttaagtaggattgttgtattggatttattttttattgaagtggaagctgcagctaaatgcccagtgatgaggaaggtgttggagtctgagatttaaggtgagtggcaatttgaaatagctgctctaggatcctatttaacagagaaaatgttgagtacacaatcagtgagcagttttaagtccactctattctgtttgcagtttcaagtacctttcattgcttctaagtttatgaaaactggttcacaatcttcttgtgcttcttatttctacctcttttccttctgttttctcacctccccagtttaaacagtcccgaattttttacaattaaatatacagcaactgccatgaaatctactgataaaagatactgcaaaatcagtttgggattgggttcattagcttacttattattatcaatcctaggccactaagcaaccttgcataaaatgcataaaatgaggagattctagtggaggatagttttcaattatctcattaatttcaggccatgtgactagtccaaatagatattataggccaagaagagcctatcttgagattttaactcccaggataggttttctacctgatcaaaagaatctaataactattcaatctcttcttaaatggtttggttttctgtgcaaacagttttacccttttagctgattttctaggtgttaaattaagaaaattctctcagatacttgttcatcatgtactaggatccctgatgtgttcagagttgtccaactttcaaagggctttgcattcagagtacctaatctaaaccctgatatcattcttttataacagaaaaccccggattagactgggacagtgtctgtcatgttcatcactgcatctccctcagtatttgtagaatgaatgaagggacaatggcaaactatagtcctaccatcacacttttggtagtgaggagaactgctgtaacttggaagattggagggggaaaaggtggctaaaacaatcatacagtaaactgggctgctatcaagagaaaccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttagtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggagttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaaatattgattattgccacaatttcagagcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaactcgacctttctctctggctgcccttaacattttttccttcatttcaacttggtgaatctgacaattatgtgtcttggagttgctcttctcgaggagtatctttgtggcgttctctgtatttcctgaatctgaacgttggcctgccttactagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagtttttcaaaagcaatggcaacaaaagccaaaattgacaaatgggatctaattaaactcaagagcttctgcacagcaaaagaaactaccatcagagtgaacaggcaacctacaacatgggagaaaatttccgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatccaccatggaatactatgcagccataaaaaatgatgagttcatgtccgttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaattaaaaaaaaaaaaaaaaaaaaaagagaaaccagtgctctattatctaggtatataccaaggttacccactgcttgactctcattattagccttctttgatgttctctggtacttgatgtctttcataactaatcaatgtattaatgtatccaatcatttactcgataactttattgaaagcaaaagcagttgcataccagctatcaagctggaagtgggagatacagccgcagacaaggcagatatggtcccagcccttaggagctcccagagtagcaggaggtttccccttccagtgtcttctctctgcttttcttcaaaaggaaaaggctgatgtgtataatataccatatctctttgaagttctctgattatggattttaggtttaaaccagttcttcatccatgactttataaattgaaaatccaggattttgctgtgttgttgtgttcttgttttgttttgatgtccctgttttctctagatacagttagaaatgtctaggaagaaatttttggttagtatgggagccccacaaagccatttttttaaacataaaatctgtattacatatcaggtatgaaatacagggggaatgaatcatttctccgtaaaggaaaatttaaagtaaatttcaggaaagtgaattctttcccgtttgcattaccgacagatgcagaaactttaatcgtcatttgctaagagggatatggcagataatacacaatagatgtcgtagcaacattcactcgcattctttttttttttttttaaagaaatctttctttcaagaagctattctaggatctttctcatgacagtgtcctagttcttatctttgctacacacaggctcacaaagtgttttctttgaagggcattttgttattggccctcttttcatttttcttttccgtagcaaacagaaccgaaggtgtttactccccacggtgagagggcacctgggtgcacaaacagtggtgtgaaccactggcctttctctgctttccgttccctgaatgtaagaaacaggtgcagtgatcaattcactgcgtgcagtgaaccccaggcagaaagagaacgtcgtgtcacagaccttttgttacttggagagaatgagcgggaagaaaggctgcctctgctgctactgagacccttttgcccattttattgactgctataggttcatctatcctaatttgtctccggctgtcccagtttatccctgttattcttgtgttactttactttactatattttattttattttattttatttattttagagacagagtcttgctctgtcacccaggctggagtggagtggcatgatcatagctcactgcagcctcaaactcctgagctcaagcaatcctcctccttcagcctactgagtagccaggattatagctgtgcaccactatgcccacctaattttttttttttttgaaatggagtctcgctctgtcacccaagctgcagtgcagtggtgcgatctcggctcactgcaacctccacctcccgggttcaagcgattctcctgcctcagcctcctgagtagctgggattacaggtgcccaccaccatgccctgctaatttttgtatttttagtagagacagagtttcgccatgttggccaggctgttctcaaactcctttaactgtttttttatttttatttttaatttttaaaacatattgtagagataagagtcatgctacattgcccaggctgatctcaaactcctggcttcaagcaatactcctacctcggcctcccaaagcacctggattacaggcatgagccagtgtgcctgaccctgtgtgattattattagcatcctggacactctcaaaagtgttcaggtttggacaatgaactataggatcaccctaattacatgagattaagagtagagaccttgaccaccagaaatggtcaatactcaccatatattttcttcctgatgttagaacctggtacttttgggaaatgaaattgtacatgagatatatgcagaatgggcgaagggagcgaaaagatttaaaaaattaagctcgatttattgagcgcctcgagtgcgctcagtgctgttccaagtgctgacagcagagaggtaagttctgttctccagtgttcacctcacacgtgcaagccaggtttgaaaacacactgtctttccttagtatccctccacccctccatgtgactatacgtatgtatcaagtttgtgatatttcacttctgggcttcttttcatttggaaatttaatgtcagtgtatcatgttttaattaataggacatcatgttatgaaactgttgaatcgaatattttccctaggcatcaaattacttgtcagtggaaatttgacatctagatatgagggacaaaagagatgagaaaaataatagtaaagtgttcctaaaggatgctggtatactgtttaggtattttaatgcactgttacaacctaaagtgtcttgtaaagtatgttctttagaaataaaataaataaaacaagacatctctccataggtacaaatccacttgccttcctcaattcctatccttctgtgatgggaaatctctgctgtgacaaagaaccatgttaagaaaaccataaagttgtattgtttgtagatttttttaatgactaaaggaagatattgcaagtagtagaaacaaatagaggaggtggccctgaaggtcaatataacggagttcactgcagaaaagagaaactactctaggtacgttagacacatatcaaagttttggaaaggctaaagtagcaggttttagacttggcttcgaggacagatttctaaaactatatagaactgatccaataagaaactaccatctccggggtaccactgaagcaatgatttcaagaacatactttgtaaataggaactaggaaccaggaggttgaaatctagacgctaccacttttgaagctgctgttagcaactgcccttctccagccaggaagctggagaaagaactttggaactctgatgtaggaaatctcatgtttctttgactaagctcgccaacagaaatagccaaaaggggcagaaaggtgacctatgcctcacttccactttccagatctctcacaagtatacacatttggcaaaacgttgccagatttagcaaataaaaataatgcatgcaacatacttaacactaaataaaaaaagattgtgtagaaaatttaaatttaactgggtgccttgtattttatctgacaaccctaacttattatatcctaattcataatcagaacactagctgcatggaagtctggcaaatacagtttttaatttccaacctgtccaactggaaggatggtaagtagatttaggtgagccagttcacagtattaaccaaagtagattgcctaccaagaatagctaaagcctttctgcccccagacgcttatgctaccatctgaatatttttactttgcattcttatattcttggaaatcctatcaatctgtgattcagattggtttggtttaactcagcttccccttttttttggagacagggtcataccctgtcacccaggctggagtgcagtggcacaatcatggctcactgcaacttcgacatccctgggctcaggtgatcctccctcccacctcagcctcccaagtggctgggactacaggcacgtgccaccacaccccgctactttttgtattttctgtagaaacagagtttcgccacattgcctaagctggtctcagattcctgggctgaagtgatccacccaccttggcctgacaacgtgctggaattacagatgtgagccaccatgcccagcccctctttttaaaatataaaaatctcccagaatgtgaaagttgtcagtctatactttgggaataagattttcaacagatagaagagaatgaggattaaaacataaggaagtttgggagtagaaaatatgggcaccagaaggtggaaggagagagcagatgcccatttatatatctcctttgttgggtgttggacaaatccaggtcttaaaataggaagtatttcttttccgtacttcttgaatctttcatatcccaaaagatgcatatttcccaaatcatataacccaaagtcatgctatcaaaatgatataaatcatccatggtataggttaaatagctatatatgtatatgctggtctgagacatgtatatgactattgtgtccatggaaatttgagtttggggttctggaccatttatttgcaagtgatttttggttagagaactctttgtaagttggggattgcttttacttattttatgagtaaagatgtcaaaaggatgactgctaaatttgcactgtgttaattcactatttagtgagaagaaatattagactagctatgaaaagtaaaactgcctctccaaaaagtcaaagctgatgaaaaacagtcatacaagcacaatgccgctcttcggaaacatggaaacactttttccttcccaattttccctcagattttctcttccgcatttaaaacacttgggtggttcaagtttctaggctaccactgattgtaacagcaaacagtagcaactggaagcagtgggatgttgggagaagtaatagaggtagctgctacccaagttatcctggaggattttccatggcaatgaaatcaggtagtagaagcttggctaactgagtgtaagcaaacagttctactgagaatggtgttgtcttttcaatccgtttatctgtgatggtgatagtgtgaaacaggggaattttatccaaggtttaaggaaggttatttggttaaaagaggatattgttacagtgaagtcaaactttccattaactttttgctgtaacaacagattgaacgtagcatttcaccgtcaacgagtaaagtgaaatttacagattaacttatgtgcctcttttaaaatatatcagatttctaaattgcttttatttcagaggtatgggaggttcactttctctttgaaagtgtacattatttttctagtgtcttacatctgcctacaaagatgttattttacttgaaagcacagtaactatttgatgagaatttgtcagcatcagtaaattaaagaccctcaaatgatttctactaattatagtttaattccgtacatttaatgatattttaaaacacatgagttatttcataactcccaacatcacaaggataaattttattctacaaacaaaatattgtgctaaatgaaatagttcatttaggcaaagaaaggagcacagaaaattagtggaactctctgctgtaagtaacgtagacattacatggcatattgagtctccatgaatattgtcatgttatgttttaaaaaggtgatcgaacatatggcatttaaaagttccaagtcctcttttaaatgcttcagaatctattatttaatgatcatcttggatctcaaaactgatcttttgaaagattttattcgccccatgtgttaatatgatttccctgtcatatgatatgattatctatcaatacttaaaaccagcagccaagtaaaaaatcagttcatatcatttaatgaatactatgagtcaggatctgggtaggcaagctattttcgggtttgagtagttccaaagcttaaaaatcttatattgattttacagtgaagaagaaatagtcttagctactttggaggtttcaaacattgactactcaaggagtatttccttgctttctcaggcaccaggcagtttttcaggagcaagcattcatccattcagggaattgtaacctgtagtttccacttttctagcaatcacacttaaaaccatgagagtaggccataggacataaggagctcagcttctcagggcaagcacatcctttcagctttcacctgtccgtttgttagtgttcacttccgtgctcaaggagtttcttgttgcctctgagttctaagagacagaacgaagggagaagggtgcagaagtctaacgcatgttcatggacttatctctccaataaagagcttgttttatcttcttttatttatttattttttctaatgaagccattagcctcaaacaaagccatggaatcttatcagagtgaaaccggggtcattccataggctggctgagtgagagctccatggcacgatgatgtatggtcactgcacaacaacgcctttgccacaacacatgtgccttttaattacactttaaatctcatttgaagagatgttatcattatggaaattgctctgtaaatgtgcccaggatgagacccaataaaagtttgctgagaagaattgaagacagaggagatgaatcagcagctaaaacattaccatcagacagaattttcttggctgtaggcaaaacagcccatgcaataacagaaaatcttcattgactcagaggcgtattttccctagattattatggggcactcctgcctgtagcactatcacttctttgataagctgaaggaagcgttctgctctccagctcagcgggcctttttctccccaacctcagagccatcatttgaatttatagttgccaaaatgaataatacagtattgcccttgtgttcctgacttcatgcatgcatgcagagcggggttaaggttctttaaatgaaagattgccttctattcatgcaataaagaacacctctgcttcctttccagggtcatttaaaaataactataccgctgggctatggaaagcacataagaaagattcttagggtaaagtcaaaatgctcttttctctacaacaggcattgtctcatatctttgtgtagcacagctgatttgaagttttcttttaagcacattcttaattatcttttcctttgatcttgaactgtttccctgggctaccagacagagagcctagagccctacctccgctttccccgaggtgcaaactgctccgtccttccacaggcaggcccctggctgaatgcacccttttctccatggttacccacccacctctctgttatttgttacttcccaagtgaatggcaggttaaaatgggaaaaggtcaggttatctgaatgtggttagagtgaaatgaatttcctcattgcacccaagaactgtcctttgacaggtctccttccccaaatcgggtcattttgtacgtaggctcactgggagtaattctaagacaactaaataagtaaaatcacattttggtgccattttccaatgtattcttcttcttgggggttctcctttaaaatggtactggaaggatacgttgtcttcattaatccattgtatgtcccgggggtggaggtggaggtggcagtagcagaagcccgtgaagtaataggtcgtattttgtgtttataaatatttctgcaggtttttgaggagaagatccatcattcttataaaggcattcatgacctccagaagattaagggctgttatgctagaacagtgtttcattcttaaaatggggtctctggactagcagtatcggcatcacttgggaacttctaagaaatgcaaattcttgagttctaccccagacatacagaatcatgatctctcagagtggagcccagcagcctgtgttttaatgagccctctgggtgattctcaagcccactcaagtttgagaaccactgtactaagggaactactgatgcatgatgcaagttcacgctcacaggcacgtgtgaatgacacaaagaacacagacgcctgagagagcaagaaagacaacatagactgtctgactccctgctgggcccttctttaccgcccctatttcaggctaccatgcccatgagtggatgacacgtaccccccgacaaaggtcaacaccactctcccttccacaccctatcactaagtgacaggctaagcctatgttaaactgctcacatctccttggaaattcaacactttaataataggtagcattatcacccccatcttcttctctaagccagaaacccaacttgcctccctatatgttatccttgcattcagtcagtctctaagttgtattcatgatctctcaaaaatatctccctttttctcatcctgtgtctattacctcagtttagatctccatattctcttgcctctaatgttcttgcctctaatgtaccttttcactgccaccaagatgatgttaccaaaaaatcttaaacagattagacatcttcacaggataaagtccaaacccttagcttgatacacaagccccttcacaatccaggccctccttcctgtgcagctatatatatatatatatatatatagagagagagagagagagagagagagagagagagagagaaattttgatcttaccactctgtctctcttcccgccatgggtcttcccctcttccctccggagttacttagctctgatgtgtattcttatctcgtcttatcttcaacttcattcatgtttttcccactgcttcaaatttcactctcccacttctcccctggccagctgctactcatccctcaagaccctgatcaaatatcatcacttgtatgatggcatctgcaaatcttggggggcaaggctaattgttctttgttcccacagggctgtgttccagtttaacatgatcacatgttattttggttcatttatttgcttaagactttttcagaaggctatgggctctttaaaatagagaacttacatcttgtagttttaagagtatttttagtaaaagtttagagtgacccccatctttctgccagcccacaaaaggaaaacatcaaaaagtgaatgtgtaaaaggaagagaactctgacaaaaccaggcagaaaggtttttcagcaagtctttttattttctgttcaggataacattaataattatccacgttggtttctcattctcctgttggtgaatatttttctgctaaatttaaaaccgtatcacaaactcaagcagagatttacaacatttcaacagcttttctacccctgccttagaagggtggatcaaaaacatttgtccatggtaaagcactatggacatgacttagttaacaattctctgtttgggtcaccatgaggcttcttcgtttatactcagggtcagcgacaatgctgatatgcagctacaatttctcatttcttactcagggtgttatgaagcagatttccactgttctttaatcgttattaaaatgtagtccaggtgcagtggctcacgcctataatcccagcactttgggaagctgaggcaggtgggtcacataaggttaggagttcgacaccagcctggccaacatggtgaaaccctgtctctactaaaaataaaaaaactggccgggcatggtggcaggtgcctgtaatcccagctactcaggaggctgaggcaggagaatcgcttgaacccaggagggggacagaggttgcagtgagccgagatcacaccattgcactccagcctgggcgacaagagcaaaactctgtctcaaaaaaaaaaaaaagtcattctcatgtaaaaattcttgtaaaataatctgtaaagtcatcctcttatctgttctagttcttcataagacttatataacatgtcatatgggcatggaaaggcctaagccttcccaaaccttgctcttttggggatgattttccaaatgtacttgttctcagttgaaaagagcattgcggccgggcgcggtggctcaacgcctgtaatcccagcactttgggaggctgaggtgggcagatcacgaggtcaggagatcgagaccatcctggctaacatggtgacaccccgtatctacttaaaatacaaaaaattagccgggcgtggtggcgggcgcctgtagtcccagctacttgggaggctgaggcaggagaatggcgtgaacccgggaggtggagcttgcagtgagccgagatcgcgccactgcactccagcctgggcaacagagcaagactccgtctcaaaaaaaaagaagaagaaaagaacattgcatcatggcacaaggacacaaaaaataccctggacctgcttcagtgagatggtctaagggtctctagcatcttctgaactgaactgaatgctttgggaagaattaatagatacacgatgtatattagttcgtttcacactgctataaagaacttccctgagactggggtaatttatttaaagaaaaagaggtttagttgactcacagttctgtgtggctggggaggcctcaggaaacttataatcatggtggaaagcaaaggggaaggaagcaccttcacaaggcagcaggagagagagagaaagagtgaatgggaagagccccttataaaaccatcaaatctcatgagaactcactcactatcacatgggaaaacagcatgggggaagccacccccatgatccaatcacctcccaccaggttcccccggattacagttctagatgagatttgggtgaggacacaaagccaaaccatatcacaatggaaagctcatgaatgggttctaagaatgaggaaatgtaccttagcattttgcctacttttcctttatgacatttttttcccggcaaatatgccaaatattacctacctttacatcagtgtccacatgcatatcccctgtcttcctccttttcctcatacattaacaaaagagtaactttgttttctccccatcactgttcaccctattgtataagagaagaaaagcaaaataggatgaaagaactatctaggcacacacacaaaagtcacactctccagaagaaagaatttgctctacttggtagtagacagaaattaactcactgaagatcaccagagaatcagatccaattatatcagcaggactttagtttacatcatggtactagaaccttctttaacattcaaaacttatgaatacctagaaatagttttaaggttaatatctctatgctgtgggctaaagagtacccacaaatgaatacagttgtgtctgatgagtgtctgtgattattttggaaattgtcctgctatttaaaatgaaaaaaatagaaatgtcttagattttcctatcattaacctattgtaaacaattacatcagtgtagggttgttttgtggttgcgtgggagtattttgaggtttttagggggtaaagtgggggatagaatgaagttgttgtttgcatttacaaccctaataattaaaacaagccagagggaattacctacatggctgttgtgatttctagtgtatgatcaaaaataattatggcactttgccatatgttcttgctttcttcttagatatgtgttattgggaaaagatgagacttgacatcaactaattgcttttttctaatatacaaccttgaaccacagtgattctctggaggacaaaaaatagcttagtgacaaagagattccagaaataagagcttttcgagcttttaactctctatgtaatatagacaaattgcacagattaatataaccaaatatgtattggtccatgggaagagagttacctatttgaagaataggagtgtattgtgttcatttagaaccattcagaaacatcaatgatattagttctgagttgactaaggataaatttttaaaagcaatacctaattggaaaattattcagttgttgaccattcctatcagtgctctgaaactaaatatctcacagatgccttaatgagttattataattatgttgctgtgatacatgtagcccaagtcagaagtcacttgctttgtatttaatggatggggaagacactggagcttggagggaagagaataaaaataacctagtttcaggaagatctatgctctaaccctgcttctgccacataacaacaactctatgatttgtataagttactttacctctcaaactcgtggtttcctcgataggggataaagaaggcctatttcatagagttggtgtaaaggatttataagggctgtaagtattagttcctgccctgtttcatccccctaccctacccccacccctcatcatggctctgcaaaaacaaatatgtctcagagttggaaagacccatctggtctttctcagataagggtagttttcttcaaacagactgattcctgcacataaaatataatataaaaaaccaaaagtaccttcaacattgtagacttttcatatgtggttgtctctgtgacttaaatgtacaatctagggtttgcatgttaaggtctttcaagattactgttggcactgatctgaaagatgtctcatgcaggaaatgctcacccaattatgagcactgaggctgtatagcaatatcagaaataatattgcagcacagtattttctatggattttagatgcagtattaaaaaaagaaaactcagcctgtctttaagactcgttttctctttcaacaccagaattaaaaggcatgccattcttttttaaagtttatgtgcagagccaaatgaatatcaacattagttctccactgggtccacggcttctttttaaaaatatctgaagcagtgttactctacccactttttctcaggaaattgtgtcctttagaactggcacccatatagtttaggaatgcttgatagggtatattttaggtgggagtcacctgtgcctatatggagctttgatgtcaatgcccttgtcatttggtgtcaatggttttgtcattctaatttatttggccccaaggtgtgtgtgtgtgtgtgtgtgtgtgtgtgtgtgtgtgtgtgtgtgtttgaaacacagcatatgtatttttttcttactccttgagaaatagaactttaaataacatttctatctttaaaatgtacttgtgaatagttatcactttcctgaattctaccttccaaaggtaggacaagagaaggatggaattaaatcacacatgcagctatttttataacttatgagcactcaatgatggtagcatccctcttctttaccttctctctgattctgaagccactgctgttttggttcctgtatggctgggactgcctgtccactagacttcctgccttcactctgaccctgctacatttaccctgaacaccatcctcccaataatcattaccagatgctattttcacaatgttacacctttacacaagaagctacagtggaatattatccttacagaatcagataaaaatctccaggcggcattctaagctctcattggctacactgtaccctttgaacctgaacttcctgagaactacctcttagctcctgcctgtagctctggctcccatcttcatgcagtaggtattcgttttcttttgaacggcctcatatcttctctgctagcaggattggagtcatggcagaaagtgagagggggactagaaggatgcaacattaatgaaacctcacaataggttaggcattgggttaggtacttggttgatctactcacatcatctcatctaatctttgccaaaaccttaaaaggtaggtattatcggccctacttatagacatacaataggtacttaatgcacatttttgtgatgaataaatattcgggaatttttgcattgtgactggatgagaagaaactaggaaaaacaagacgtagatgagaaagatacctctcatcttacttccaacctaggagatcttaaatgaactcatcagttttaaaaggtaatcttaagaatggagtcagagggtcacacaaggagagaaagcatcacgtattaccagagttcgggattgcttaaggcggtttgacagtttcctccgggggtaatccaccctaggccaggcatttttaaagattagattttgaaatgaagctttgcacttgggaatatactgaggcaagaaagcatatcccttctccctgctgagagagcatatcccttctctctgctgttgcagtgcttaagtgtgagaattttcgaatgagatatgaaagcaaagacaacaaaccctgcaggataatagtctctgaggactttaataacagccgtttttaaagcaaagcctgtggactcctaaatccatagctgctcgtttaagatgcaacgcaatgcagtggacctgaaaacatactccttatctacctagagcaaccaggctccaagccaaacagcagtcctcaaattaactcttgtttctcttgggacgacaactctgctgcttttaaaggtgttgcgtggccacatatagaataagaagggaaaaaacagtcacaccctcttgtgagtctgtatccaactgcattttctgatctggttaggaacctccggtggttagattagaatcctgataaggccaagactgtgggtccaatttcttcctatggattcttctcgaaaaacttgttaggaaagatccacttcgggtttttttttttttttttttgcgcttgttttaattcccaatccataatagactgatacttttgtaacatgcaataaaaatgaattattttaaaaattacaaataccagacatacaaaatttaagccgatgctttttatttttagattgctgtacacgtttctaaagatttgctttcaatttctgttcttatgtcttcataatagaatatctgtttctgtgtgtgtatacgtatgagtgtatgcaagtgtgctccaaaagctctactatttagagctcatgtttaatgagtcatgttggataaccagtctaagggagttctactttcatataattgtttttgttttatttttatttaaatcattaacaccttttcaaaacaactgtatcaaataacagtcatttggtcatttgaagcatttacatacactgctttcttcttaaacagattttactgaatgtaaatctgctttccctggctaattcagcatcatcatcctgagcattaactattttgcttcgctataaaacgaggtgatgccttcaagggctactgatgcatggagagctgttagtttccacactgtgtgaccctggtcaattatgcatgcccatggctccttttacacctttctgattctctgtaaggtgtcacttcttcctactctcaatttagccacttaggataatttctttactattttgaattgtatgttcctgaccttctaagttcttagaaatcagaccactttttttcccatcaagctaatttaaattagataaaaattatcagtaaggaggaactaatggccttataattattcatatactaactgctttcagaaaagcttagagataatctgtctataataaaattcttaaggagatttggtcacttattgttattctttctacaccattgtgtttgtttccttacttctcagctatattaaaatggggaagttttcatttgctgagtcctattttagagaccaataattccatttacataggaaaggaaatatgtggatacgattattcatgatgttctagaatagtatcacaaccatctgcttaatggttaataaaatggttaataataaaaagaagggtacagcactaattcttgacatctcccttctttatttttcttctagtaaaacatccataacttttcctattcttccccagttgtattattacttatgaacaccatggatcattctactttttgaatgaaatagtacaaatttaatattcgataatcttgtctttgtacttttctttctaaacttttattctcggtggcttcctaaaggaagactttattctacttggtttaagcagttggtctgcattctacctatttctctcaactctcattgtccattccaatcaggttgtgcaattcattgtccctgctcataaaccaaattcatttcacctttactccattcccatgctattctttttacctggaatattttcttttgttccaatttcccaatcgtatacatccctcaaggctcaagccaagtcctgtaacttcatgaaatctatttctaacatctgatttccacatggattatcttgtaatagtaagccctgcatttgctattatttattaaagatctcttgtgttctagacgctattcaaagtattttacaaaaattccatgtaatattcaaaaaattcagcaggtatgtattattatttcatgtttagtgaaaccaaagtaatgaaagagttttcatcattatgtggctaataagggaaagagaagagaagggtcaaacctatgtctatttaactgcactttgccatgagttttctctggaagctgagaaaggagattcacaacaagagtagatgagactcagataagaaggaagtgtggaatttgaaaaagcccttcagaaaacaggatctcccctactcctaaaactgctatactgtgaacatattgcttgtctcataactgaacttttttggtactctcagctgaaatttgctctataattgtacagaactttaggccaaatgtttcttttatggggacacacattatttgtttcgtttgcacccattttctcaattactttgtgttttctcttgttgtattggatgcatctctatccactgctacaaatctgtttaatagtctttatattaataagaccatgaaattgctctttgtgtgctgacatagttatcctttattttctaatggcagtgctagatttgctaaaatttaggtagtagcattattaataggaaaaactaccaccaacaactaaacttgaaaggtaatatagcctagtggctaagagcacaatccctgaagtctgactgacgaggttctaaatcttgctgcatttattagctgtgtgaacctgggcatttttagttaaccttacagtagtttcattatcttatatggaaaatgaagataatagtagcccctaccctagagggttgttgagaggagaaaatgagctcatgtatatacagtgctttggacagcacctgatgtacagtaaggttcatgtatgttgttgttcttgctgctgctgctgctgctatggtttttgttatgtaacaactaccttttcccctttgttcattcgttattgcttttcctaaagactacaatcacaaaaaagaagaaaaaaattagagagcatacagtgaatgcagtaatgaaggcttgaatgatcttttctagttaagtcagaagtgaaataaaactatccaaaaatttctatgaaaattatcctttgtccagattggctacccactgagaactccacttgattctccatatcaatcttttgctcttttgtgctacctgagtctgaggtgtagtctttaaatgatgagtttattggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatgcaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtgatttacagattcaatgccatccccatcaagctaccaatgcctttcttcacagaattggaaaaaactactttaaagttcatatggaaccaaaaaagagcccacatcgccaagtcaatcctgagccaaaagaacaaagctggaggcatcacactagctgacttcaaactatactacaaggctacagtaaccaaaacaacatggtactggtaccaaaacagagatatagatcagtggaacagaacagagccctcagaaataatgccgcatatctacaactatctgatctttaacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatgtacaagaaaaaaacaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcatttaaaagtcaggaaacaacaggtgctggagaggatgtggagaaataggaacacttctacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaaaggatgagttcacatcctttgtagggacatggatgaaattggaaatcattattctcagtaaactatcacaagaacagaacaccaaacaccgcatattctcactcataggtgggaattgaacaatgagaacacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcacgttgtgcacatgtaccctaaaatttaaagtataataataataataaataaataaataaataaataaaaaatgatgagtttagacaaatatcattatggtagtattatattatgttatgttatattatattatattatattatgtataatgtatattccttgcagcctgccctgcattcccaatctatgactcatgctgccttattgatactgaaaaatctccactacagcatgccagcttttgaaagagagccttgggttctttcccaatacttaccttccttttagggcaacctatctgagtcctgtagcttgaaagatttcctaccagcctgccatcccaaaggaacatggatgaactatgtttatgctgatgtgtcaagtcatttcttggtatggttcatagtagtccacatggctcttgtagacaaagagatgaattactgatggcagaatttctgttctggcaacagggaaatttgcagaaaggagaccttttcagtgtgaacattttttgctcacaggtggtccaggatgcccaatgctaaatgagaagtgaaaagagcaatcagggccaggtgtggtggctcacgcctgtaatccaagcactttgggaggccaaggtgggcggatcacgaggtcaggagatcgagaccatcctggctaacatggtgaaaccctgtttctactaaaaatacaaaaaaaattagccaggcgtggtggcgggcgcctatagtcccagctacttgggaggctgaggcaggagaatggcgtgaacctgggaggcggagcttgcagtgagccaagatcgcgccactgtgctccagcctgggtgacagagcgagactctgtctcaaaaaaaaaaaaaaaaaaagagcagtcagaattcaatttttcattcagaacaaatcaatccacgtgggtaaacattttatcaaactcaagaatgctgtctttcagggtgcttttccctcaacagtcacttatttcctcttgcaagtagtatcttcgttcaggttcagtgactactgtgtattatatccaatgcttctggcaagtgggttggtggaggcagcccaagatcttctagaatcaagagaattggatccatttcccagttctaacacttatcagctatatggcttttaggcaagtcagttaaacatccgagtctcagtgctctcatctgcaaaacagaaaatgtgatgtacttcacagagccagggggaggaataactaaggtggtacatttgtacgtgctttgtaacctgtaaagccctttactgtacacgtgtcatttacagctctgtatcaccatcatgacctagaaaagcagtactgacagaagacttatcttcttgccaatgctaagataactttagccatttctgcatttctaaaggaaggagtctttatcccagtatctatgaagacttggcaggaattgccgtcaatatttagttggtaatataaacgaattaaacaaaaatgcacactaggttttaggaaaattaaagacagaactatcatttgtactcctcttacatttcccaaagtgctaaaactagacaataaatcagtcctcaataaatgcttgtttatcaattttatattcatttatttgttgataatacaacaaagatgtttatatgcagtataatatatatggcaaagatgaaaagtagcaaattcatgaatcaacatcctatttatgcttgagaagacaaagaaagtgttggtgacttcatggtatacataaccttaaggagctcgtgattgagcctgggtctctgctatcaatgtaggatataaatttcaaatgtactatcctttatatgtatgttaatgtagtaaacatagaaaactgatgctactagtgagaatacttttacttgaacaactaaaagtttgtctttaatcccctaagtgcatacacaaaaggaaagtactgtacaaatcaagtacaacagaagaagtaaagtaaaagacaagtgaaggaattatctggaacttagatctggttggctttttctcctgaagtacttagataaattaactcacttttctcttttgctgaagaagtgcaaattaggcaggcatgttattccacgtaggcaaaaggaaaaaagaaagaaaaacataaaatggctatatatttgaccaaacttcgttctgcaagaatcccaatactaaccttctaccatataaactactttcaaaatcaggctatatccttccagtacaaacctggtttgtactactcagagatactactcagaaatactttcagtatttcccttctttcaacttctgatgtgattctatccatattcccctgcctgtctcccagtcaaagagaatgggacacaactctctttagagtccatcagtgatgctttagctgccaaaaatagtgacaatagacattcattgtctgtctaccttacttgttcaacattcagaattctgcatcttaagaggctgtggctgaaaacttgagccagttcttcagaatttctaacatgttatttctgccactttttctcccttactttagcagagtaatttaattcaatttgagagagagagagaaaaaaaaaacttttctagttacacagatcaatccaattgtttggagcttcagaatgaatttttaaacttgttgaacagaagcatacaaatctctaagagcaagtcagataatatacaaagcctccattcattgtgtaggcagaaaggaatgctggtacccggcagctctctgaggaatgttcccttggctttgactattctgctgggaacaaggaaggaaacacatatataaaatgaatttataatgtctctggcttgtaatggcagaatgataagaaaagttggctgtttaatataaactgtcagttgcatattccaggcctcctctctttgaggttcctcccacatccacacgcctggctactgtttagtgcggagtacaaagtggccgtttattattattgactggtgaggcctgtgctccaaaattcattctgtcaacagaatgtaagcaaagttggcattttaaagcagggctctttcagtttctgggttttctcaggattgctatgcaacaggatcagtgctgtagtgcccggttcaagctgaaaatgttacacaggaagacataccatgtaaaggtcagattcttctactataataattttcttgatctgtgtgtatacaagtgaagttgaatgcataacctcttatcataactcttaccaaggtcctatgtactttccacctgtcaagcctaaaaatgtgtattaaatgggaaatcaaaactaataaatgtatgatgctgtactatatgtatgatgctataataccaaggtgaacttaatttgtgttgtcaagaagattttctctcccatgacagactcccaggaatgtgctggtgctgtgggccaagtgcaatcttgtttattagtctctccacgcttttatggtcagagttaactctacagattactacgtaaatagaaaatatgacttgatccatatagtaatgaaattattggcactggggtacactttatcatagaattttattgcctatcacttccataaaataatacattttgtccatagactagaagatataacttgtgaactttataaagttataaatacattactttccaactcataatggcaaggaataaatctattacaactaataagatgcccattttaaatctacataataacaggagaaggcaatacgccaagaaaagggatttgagatgtatcttcttgttagtttagcctgattgaaatgtcttttgaactaataattatttatattttgcaattctccaaattcacattcatcgcttgtttcttttgtttggtaattctgcacatattcttcttcctgctgtcctgtaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtaggaaaagatgtggagcaaaaaggccacaaatgaattaaaatggccaaattttcctcattgtcttagcacaagtaactggtatctcacatgtctacgtaaatcatccaatttcagaatgattcactgtattttgaataaatgaatcatttatttgcttggtatggagatgatacttgaggattcagattagattaaagtggtaatgttttataaacataggagacatgcatattaagacatcagagtgaatttaaatgaggagtgcagctattctagtttcataaatttctctcttggcatatcacagggttatacaaaaagtgataaaaaattaacggatatgtattatggaattatttttggcattagtctaaatgcataccagaggacagtctttaaaaccctttataacacattacaattatataatataaaacctgtaacacattataattaacagtttagaggagatagctcctacagttaaagagagactatagcaacttcctgtcttttgcttcctctcagattttgttaaaacacatcctctgtaaactaagcttttagttgtagtatactcacatactttatattttgcccccttctatgtgccagctttctttggagaagttagttaatggatgcatcatagcatctttgtaaaaagggcagagggaagttcttgttataccagttttgcaatagttccgtggaggaacaaaaggatagagatagtaagtaaaacgcccattgtaacttaaatgatctagcaagggcggggaatgaaagccaggcttcctgctttctaagcagttgcctttcttaattcatttctctttattaaaaatattttgtgctttcttctgtgtctagagaaaaagtgataatgaagggaggtagaagatgaccaaatggacttaataatagttatgggagtatacactaaatgacgggagtagttactacctctaggtagaaagattacagaagggagattttttttcttctttatagttcttctaacttgtccaaaattttaacatatatacttctataaggaggaaaatctgcatttttagtaattcagaagcactattgtaaatgtctgcatcaagtatgaaataatgatagcaactaatatttacatgatgtacctacataccacgcaatgccataagcactttccattcattgaccggtttaatgctctcagcaaccctaagaggtagattttattattgaattctttttacatttgaagaaagtgaggcacagagaggctaaataatttccttagggtcacttagcaagtggaagatacaagatgaaaacagggagtctgggtgggccaggcgtagtggctcacgcctgtaatcccagcactttgggaggccgaggcaggtggatcacgaggtcaagagatcgagaccatcctggccaacatggtgaaatcccgtctctaccaaaaatacaaaaattagctgggcatggtggcacgcgcctgtagtcccagctactcaggaggctgaggcaggagaatcgcttgaacccgggaggtggaggttgcagtgagccgagatcgcaccacttcactccagcctaggggacagagtgagactctgtctcaaaagaaaaaagaaaaaagtaaaagaaaaagaaatcagggagtctgacttcagagtctgaacttttaaccaccatatgataccgtagcatataaagaaagaaggaaacttctacaaagaaatgcatactaattgaaaggatgaaatagagagtagattttttctaggagtagaaaaggatttgtttttatgagaagtagattgctaggagtagaacaggtttatttttatgtataaggttttgttttgttttgtttttcacaagtttgcaccctggcttcccagacattgttccttatctccctattttgtatatgaattttgtgtcaacttggtggtggtacactgggagcaacaatggcaatagcattttcaaagatagggaggctctattagctttctacagcttaaactcttaagagaggtcagtatgtgtgatgacgtaggccactttgataaccttcgtcattaaaaaagaatgaaaatgtgagatggaaaaaatattggcaggtcaagttaagttattcttttctgcacaaaagaaaaagaaagatgctataattgttccgagtatcacttagtgccttttctctgcctcatgtgaacttgataaaataaaaggagaattgaaagtggcaaatagcatgtcagccaaaatatggactcttcattctcagcagtttcccatgtcagctaccgcagtttgattcttgctgtcattaatcaggtagaaaacagttagcttatctaaggtgctgccaattctagaatttaaatattcagatcaatggttttggcttttatataggcctatgtaataatacaggatatgttataagcactcataaaaagcaaagaagtaattctccacatcaaagcaatttagcttatttcctgacacttgattgaaattagggtattgatcaatctacagcaaatggcagggttcaattgagagaagtacagtataggcagtaattagggatgattatgaaatagaatagaataacactggaagagttagatatagaaccattagtggcactgataaacctgcattatgaatcttgtcacttcttccatgggggttattttaaaatgaaaagttgccacaattaaaaaatagtttcaatgatatactggaaaaataggcctgtgtttgcccaagttataacatattataaaaaattacagttggcccattgtttggtgagcgattctgaaactgctcttatatttcaaaaaaataaaaccattaatgtgtccatttttaaagaaacaaaattgaatttaaatccaaatgatttcgaagtttccctttgtattccattggctcataagagatatccttgtgcttccaaatacaagtccatattgtatcgttttccttccatttatttttcttctgccatacatcttttctcttcctgtgattaagattcttatttaagtcatcatgttatgccatattgatacatttgcaagaatactctaccttggacgctgtttatatcatattactcttttgttcaaagcttcaatcttgtaggtctccatatctccctcattcatttatttgttcattcaacaaatatttaatgaatgcctactatgtactaggcactcttctgggcacggaggatgcaaccatgaataaaacataccaaaaaaaatcactgctctaatgaagttatatttaatcattagaatctagtagaaccttctctctctgccaactgtgcctaataagtccttgctaactccttcccttctcttttctttttctgcctccagttcctttctcaccaagcatcattctgttactccccaacatagattctctgagccaagagaatcaataaattctattttctaaccccattcctactctccaacaatttcctcactctcccatatgagtatgtacccttgctggttctcacacttgcaacattctctttcctcttattctccaaattttgattcatattccataacaaatcttttcttttctggctgtttcctcactaggtcttcccaatactattctaatttacacttgataacatgtttcttcaagtgttcaagagttgctttatagggctatgcttactgcctccagctaacttatatgaatacaaaaatttcaaactcgaaatatgtgagtatggtagagtagaaagacatgggccagcagctgggcaacccagtttcccttctgttctattctgtcactaactgtcttagcatataatcttgatcaagtcacttaactgcttcagacttcaattttctccttcactgaaatgaagagtttgaccagaaatatggacagtctcttccagttctcttgcaatcgtacaattttattcttttagttctgcaatcacactttatgaacctggaaaattgtttaatttttctaccttggttttcttaattaaaatagaactgattgatttaaaaggcattatataaagtaattaagatgtctttgagagaaaagaaatttaattgaaattgtataatcctatctcataatttaattcaagaaaagtatatgctatcattccacatgcattattacatcacatgttggccaagaggtataaggaagaaaagtaagtagtcagtgataatttaagttccatcaaacaaaacgaaaacattaactgctttaagtgggagaaaaagagaaaattatttacttaaatgtacacacacatgcatacacacacagttactgatgacgttatccaatattaagatggtaattagtcaaagaaagtgtttttcattctaaaattccatatccacaatccttgcatttttaattttagaatattaataacttgagaagtggtcaagtcaattgttttacataagaaatatatatgaagatttcaatttagtctactactagattatttttccagatcattgtatatactattaactatgaaaatcacataatatgttatcaacataatttcagcagaatttacattatgtgagatttttatatttggcagaaaaatttgtaaatgttatataaaatgttcacatttatacaattgtgaacattaagaggcaaggacactgacattatatagtctgtagaagccataaatctattggggagtgcttgctattagaggttagaatagttagtgtctttgtataatggagaacaaaagaagggcaaaaagaggtggggtctacctttgagagaaaactgcaacttggacattgaatatctctgaccttctttctctctcttttagaatgttaattatgtttggatgttggagttcaagacctgtctagaaaaaaaaaatgttgacttctctttgggattctctctatttaaagagatagctcccattttaattctgtggttctttaattttttttgtttctgaagtacaaattcaaattattcatctgttgatgacaccctggagatttttctcagtgttctcttgtagtagtttcatggtttgaggtcttacatttaagtctttaatctactttgatttgatttttgtatatggtgagagataggggtctagattcattctgcatatggatatccagtttttccgcaccatttgttgaagagactgtcttttccccactgtatgttcttggcacctttgtcaaaaatgagttaactgtaggtgtgtggattcgtttttgggttctctagtcttttccatgggtctttgtgtctgtttttatggcagtattgtggttctttattatttctgcattcctcccttttctttctgcatgtttaagtgctattttattacatgagggtactaaagatttatagggatatatcattagttttataaaggaagtcaaagtgaaaaatgaattcaatataacacatttcactttaagaatgcatgcctttcagagtaaagttttattaaggatttcaaactaggcattaaccaaatcacagttgaaatatctgtgtctagagaaataacaatcactttatcagcccctataattcttagtgtcctgacactgaggagttccttaaagaccaagcaatatactccagcacatctaaaggctctgcgttttacctaaaccttacaaattgtggaaattatcagctttttagagattagcacttgccttgttaaacggtagtaacccctaagctcttgtcttcactaataaagattaatagacatagatagaagctaagcatgcccctttgaaccacctcttttattttccgttgagtgggtaggagtaagcagaatatatttgacaattagcaatgttaaaagacaaactttagacaaattccgttttgcagagtttatttgagcaaaaaacaattcatgaatcagacagtactcagaattagaagttcagaaagctccacccagcaaggtgggcaggcagtatttatagatagaaaaaggaagtgacatacagaaacagcttgactggttacagcttagaatttgccttacttgggcatagtgtaaataggcatttgccttatatggacatgagctgatcagtttacagcctgtgattagctgaaacttgactgctgggattggctgaggctcagctatttgttacaagaatgtactcttaagttgcatattgcttacatgccaagctgggttgcagtttgctatgtacagagtcagctttaggcccaatttaatttaatttaacagcaacaagcctttttgttcagagatcaaaaacatttggttaaaaccactaaggtttaaggattttctcatctaacaaaggtttgtaatttctatttcccatatctaaataggacagctcaagttatgtttttcagcagctgttttatacctttgcaatcttgatttctacatatgcaaaacaagaaggttgaactataatctctcaggttccttccaaccccaacagcctatgtatgatataaccagaaaaaaaagtcattacaaatacaaagaaacattttcaggaggagatattccacatgcaaacataggttaatcatttcaaaatatctggtatatacactcatgaaaataaaaatagggcaactgcttccgataaatgtattagaaatgtgacttgaaaacatttcacgggcttaacatggtcaaagaaaatgttttgagctcacaatgttccttacatttagatcttcaaaatcaagtcactgacaaatgccacctttgccctgtggagaccaagaagtaatgtttggggcatatcagaaatgctttaataaatgctttatcaaagaatggttctggagcttacctgtggaattgtgaaggttcttgttgaaagcagagattgttgatagaattatagaaagtctggaggtggcacctagcaatctcaattttaaacaagctactcaaatgtttcttatacacactatagtttgagacccagagctttaggttgaatacatttgtatatgctgttttaattcattctctggctgcctttcacctcttcagttcttactcagtgttctctgtcctttgtaagtttttcgcttcagtttttgtcctcctatcacatttttcctttcactcttgagctttaggagaggaaaaaaatgaagcaatttgatatgtagttaggatgatcaaacattctgaaattttatctaactccacagcttagaaaaaaattaaaggaagtccccttacccagatatgtgagagcttttcgtcttttgaggttccaggtccgtcttctgctgctgtattagctctcttgactgtcctctgtccctggcttctaacaacttccctatttcatgctattaagtttctcttagatcctttagaactgaattcccggctgggtgtggtagcttacgcctctactcccaacactttgggaggctgaggcaggtggatcacctgaggtcaagagttcaagaccagcctggccagcatggcgaaaccccatctctactaaaaataccaaaaattagctgggtgtggtggtgggcgcctgtaatcccagccacttgggaggctgatgcaggagaattgcttgaacccgggaggtggaggtgcagtgagccaagatcgtgccattgcactccagcctgggtgatagatcaagactctgtctcaccaaaaaaaaaaaaaaaaaagaactgaattccctaggtctcagttattttgctctctcttaggggacctaaaggggttcattgacccactaataatgagtcagcaccatttaacctagaactggaattttagcacttccttacataaacaaagccgcagcttgaggtcttaacataggcagcctgcccttcactatatcctcctctagacctctctgccacaaggatattttgtttcctctaccaggcagacagaggccaaacattagtcatcgttatattctctcttcccttcctctctccctactccccaatgtatcctagagacttaggggcagtcaataaatatttatttaatcagtgtcttttctaccatttgctgcttttccatgtctgagccctacctctctccacctacttttcaatatgtcctgcttgacagcctcttttcactctcaaagggaccaagctgtgaattccagacaccccaaggaattcgtttaaccattacacattacatgctattaaacagctaaaatcttgcatggggaattgtcgcttaggcttatcatggaaaagtggtaactgaaaggatggtacagaaacataaaagaactgacctctaattgtatgcaatctgcatgcactattatattcaattcatgacatttatggtatttcacgattcagttcttgggaaataatacccttagagtctggaacaatttaatttatcttatttgatggaaatgccttcatttttcctggacatattgtttatactgcaattatagaaagaaaatcttgacaatttggaaaagtagaaagattaagaaataaatcacctgtaaatctacctctgagggataacctggttgtcattacaaaattttttcctagtcaagcatgtgcatacaaatacatacacatacacaaatgttttagaaaaattcaaaaaatgtatttgttttgtaacctgttttctcatttagtaactgggatgatgaccttttccatatccataaatatttggctatgtcatcatattgaaccttgcaaaggattttactgtatgaatgcaccattatatatgtaataattcccttttaaattaagagctatttaattaaattcatatataaatttcattaatttctaaatttaaagcatatacaagtttcattacatttgaaaacaatcagtaggttggggttttgcatttctcaagcaattccctcatattgaatatttaagttgtttctgttttgttttatcaatcataaatgatgctatatataacatttttccacctatatctttgtatctttttccaatttctttgttagtataatttccttgaatttaagcctgtgggtcattgtctttgcacattttaaagacttttatgtattgtcaaattatccttcagaaagtttggaacaatttaatttcagtagataagtattctttggtgattctgtttgactaaggccaaaaggagaattgtatttgtaatgtcaagctaagttaccaaatggctaagggaaatgttgctccacctggttgctttgctttacatttcaatctttgcagcgttaaagtctttattatatttatgttataggtagcgttattatgaattaattagtaattgctgataatagctgagtgattgagcataatttctaatttacctgaagataaagctttgctaacactgcgtttcctctttgttttctggatgatgatttattttattaatttagcttctcatcttcaagtgaaatgtggattttatagcacagatcattcatttgtgtattcttaaatggcttctaaggattaacgtgttctaaatacagttgacggtaaagcactcagtctcctgcctaaattattcatgttcgggggaagctttcagataaatgtctgattttactcttccatgtgagttgttgtcttagtactttttacacaaaggaaacaaagcagaaaatgttgaaacttggtgaagacaaatcccaggtgcacacaaataaagaagggtagggggaaaggagacgcatttgggaagaggagcagaaaggaacagacgccagatggaagaactcaatggaaaaggctgcctagggtgtagaaatggaaaagtcaaaatgtggggagagacctttccatttctcaaggcaaaaagaattccagtactagcatgagtcacatgaaaacgaagtgtttttcattagtcactgcatccaattttttctaccagaaatattaagaattgttgactacaacagtatggaaaagcaatagattccagtgtgtatttcatgccaaaagtctcagcattctgcatgtggaaataaacatatggctaaacactgccttttctcaaaattgccatcaaactatcctctgttttgtggctctcaaaagtaagtagccagatttttattcaagactgctttgtagttcacaataggtttattgtactttttcaatggaattgttagaatcatcaattacacttctagatattctgacatggtacgctgctgttctttttcaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggtaggacatttttaagcctcgtgccttgcacatgttaagcacatagtaatccagtgactattttaaaattaattttgtttgaaattaagttgaatagaaatcttttttactcttctcacccaagggtcaattataaataatctaagccattacactgtaaatgtcaaacacatttgtgttaataataccctttaagaaatcgtccatctcttttggctatataaaaaaaagcttttcatgatgaaaaatattgaacatatacaaaagtagacagaatgctataataaaactcgtactcatcaagacatcaacaattatcaaatcacgtcagatcttatttattctatagctcttcccagattgttttaaaacaaatatcaggcgtgtgttattttattgttaatatttcaaaaggttaaaagataggattcactcttttaaggtaatcaccttgctactataatgcttttgaaatatcaataatttcatcatatcaaatatccagtccatattcaaatttccatttttctcatacatattatgcattttttaaactttttctggttttggtttaaataaaaattgaaatcagacccacaccttactttggttagttggtctttttattactttttgtttggaagtaattacagattcacagtaagtttctaaaatagaatagtttccctgtatctttcaccctgtttcttttcatcattatatgtcatgcaactgtagtacaattcttattgtcatttcaacatgcaatcaatagaaaaaatgtacatttacagcacatctcaattcaggctcattacattccaagtactcagtagccagatgttgccagtagctaccgattgaacagtgcagttctatagtttgattgtatttgggtttggctttttttggcaagactgcttcacaggtgttcgtgtattcttccatcatcaggaggtggtatataatgccttgttttctctttttgtgtgatgtttaatagctgttcacgatcagtggctaggggttgcagtgtgataattgcctatctctaccattccttcttcatttattcactggggtaggtctatgaaaaaaatgttttgcacttgtctcctattttggtactcagtatacctttcataccgaacaagcaaaatacgtttcaattttaccaatttttataataacaacttgttcactagcatcctccaacgatgaccaattatttctttgtttgtttgttttatttttatttacatttctatcttctctactaagctctgagtgaaaaaggcagagattttgtcttgttcacctccaagaccctagagtctagtaaagtgtctggtgtagagtggatactgataagtgttttggaaatgagaataaaagatacaagaacagaaatgaatagcaaaccaaacaaattactaccaaataataaaaacttgataaaatggtaccacttttgtatgttgagcatgtaaaggaaagatctctgtggagatacagccaaaggtggcatcttgaggaaaggtcaagggtttatattattctggagaagaggatataggaaattataaaaagggaagagaacatgaaagaagacccagggatctttgcaaaaaaaaaaaaaaatgccagggaaactgccagtttctcctttagccatttgccttcatatatttctgaatattaaattagcttttgtggtagggtgaaatgtaatggtgctatgtgttttaaatgttctgactttgaataaacagccaaaacactctggtgtacatatagaaaagcactcattgagaaggatgggccttttttaaaaaatgcattatgcgatatagtgaaatgagacagaatttctacaaaagatgaattttatgctagttccagaaaccaaagaaaatgaatcactggacatgtgcactaggagtcaggagactgagattctagtcatatttcttcataagatggattctgattgctattttgttcttcaactgtaatatgaggaaattggtccaaataattgctgtggtttcttccagccagtattttgttataaatactgcttcactattcctggttattagttttggttgcttgttaagagtggtaaaatgtctgtacttaacgcagtccttactcaggaatctcatgacaaagaacatgacttggggagatggtgatgctagagttatgagtgatactcaccagaatgaagttaatccgtccccacttggttagtgtgcttgctcagatagctacctgttaacctttcgtgaatttcacaggacttccagcccattgattactctgtgttttatacattagttcctctgcccttccatatttacctccttccaaatacaacttagattcaatcatctaaattttaataacttgttttcaaaagtctgaaaccctttgcttctttatctttttgttgctgcaatctacaaaactccaaaactctagctaaatattccgagactctaactaaatattttctcataccagacaacaatgtagttgtctggtacagtaccttttccggatgaccagccttcagccttccactaccaagacatcactgggtcaatttttttttttttttttttttgagactgggtcttgctctgtcaccaggctggagttgcaatggcacaatcttggctcactgcaacctccgcctcctggttcaagcaattctcccgcctcagcctcccgagtagctgggactacaggcacgcgccaccatgcccacctaatgtttgtatttttagtagagacagggtttcaccgtgttggccagatggtctcgatctcttgacctcgtgatctgcctgtcttggcctcccaaagtgctgggattacaggcgtgagccaccgcacctggccaatttaccttcaaaattgtttttgactgtctactattgttatcatcataattatagaagaccatttctcctaacctttctgcatctactcttgccaccctacaatgcaatctctacatttcagtcagaataatctgtgtaaaaaacataaatccaattatatcagtccttatcttaacactatagtagtcttctcagtgctcttggaaaaagaccaaaatcctcaacaagggtgacaaggcactatctggcttgtctggcctcagcctcctctttcctagatgctcttcccttgctgtttggatgccagccatactgcctccatttactttttccaattctgcgtgtccctcttatgtggggctttaaatatgttggtcctctgtctcaaacccttttacctatacccacccactcataatatcctggttatcatctaataatcctttacatcttggctcggacattgtgcaaacttttccctgttgtctacatttgaccagatctttctttacacacttctaaaattgtctacttttctataacatagcgttgtttgtcatcacgtacatgtgttactatttgataaatatcgactactcttgctaaaccatgtccttcaagaagatttttgggagggggaaagctgtcatttttctactcagcacattccaaagtgcctagtatacagtagacactggttagataaaggaaggctattgagaccaagagcagggaaagaaagaatagagtggtattcccttcttatttacaggagttttctgtttatttctaattaagcatctttttgtaaagtgtgtagagctactttgatgcacaggtttttttttattattatactttacattctgggatacatgtgcagaaagtgcaggtttgttacataggtatacatgtgccatggtggtttgccacacccatcaacccgtcatctacattaggtatttctcctaatgctatccctcccctagccccccaccccctgacaggccccagtgtgtgatgttcccctccctgtgtccatatgttttcattgtttatctcccacttatgagtgagaccatgcagtgtttggttttcggttcctctgttagtttgctgagaatgatggtttccagcttcatccatgtccctgcaaaggacatgatctcatccttttttatggcttcacagtattccatggtgtacatgtgccacattttcttaatccagtatatcattgatgggcatttgggttggttccacgcctttgctattgtgaatggtgcttcaataaacatacgacatacagcttttacttgtagtttggcgcaatgctttttcaagcttctcttggtatctttaagaaaaattcttgacacaaaacactctccttcctcaaacaacatcatcgctcctgagtgctgatgagagaacagtttagtagcctgtttgactcaaagttttgtcacatgtatgtggtagccctttcatatatggactgtctagttagtgatgctcttgaagcctatgggcaaaagaacaatggaaaatccttgaaactggatctgcgtatcagatctcctgaactcagttagaaaaagagaaaaagaacagaatcagtacaaaattccatcaagatctaatagttgacagatcttatatttgtggacttttgttttactttgccatgtttccagaattgtacattgtattgctctttatgggtttcttgatttaattgttgtttgtatagaatccttggtatcaagatgggtcactgtaattgtaaacttattccgcaagtatttagagtgccacttttttaaaaagtcatctgcttactctctattctaaattattaatatcctttgctgatgctttttatggggatacaaatcccattaaaatgtcaatagttgaaactaaaatcaaatgttgttcattttcactttcattttctataaatcaggatgtttacaaaacaggtaatttgtgtttttctttgtataccatttcagattagtgataatattttgtagcaaaatattacatatcttgtactcttttcttgtagagaaaatatacagtcaatatcaattgctgtcatggagagatatatggttcttctgtaggtaaaattccaagatactccacagacatatttggggaccatagtctcactcctcaaagcaattttcacacccatgggagtagatctgtgctccccaaaccagctgggcagcataacaactgcaactgaatggctctcaagactaattaataaaataatgctccagatgcggtgaagtgttataaataattaaagctcaaatatgccttagcaaatataaactgaccaatttttatgtcttttgaatacattatcctggcttttacagttcctcattacttgcctcactagactgactcgttttcaattagtgggtgttattctggtccagatatattttaaaaactgacttcctttgttttacttgagcagtcactaaagtgatatttattacttgtctacttctgtgattaacctagagagagttttaaaggagcaaatcatagtggggaatttctaaggagaactgcaataaaacatcagcttattcaactcccttcctcctaccccaaatccaaatggagattagatcttgattgtaacaacagtgtaggtaatgactttttgtttgcctttttactaatgaaattgtttgtcactaggttttcatctttcaattaaaaaaatctctataatcccttccctagagatcattaaggataccttcaaagcttcccgagattttctggttaagatttagatggaagtaatcaatacatacattattaaaagagtggacagaaagccattattgcttggatgctgttgacaaatgaaaaggcttgaataaagtagtttacttgttcatttgtcaggtcatatattatgcatgttcgatttcttcagaagtcaccacaaagtgagagacaggctgagaaattcaataaaattatcctgaaatcatgttgtagattatacatttatttaggctcattctgttatcagtgctggcctgcttacgtgggatacattttagtatgtatgttagcttgacgagttttctgtgttttctttttacagaaagagaaaatatctttggatgtcatttgtgaatgttaagatttaagtcagctctgtgttaagaaaaatgcgttgttccctatcacctctgaaaaacaaccaaaagttgcgatagagtgattcattcttttttcttttctttttatttattttttctttaatttttttttgagatggagtctcgcctgcagcccaggctggagtgcagcggtgcgatctcggctcaccgcaagctccacctcctgggttcacgccattctccttctcctgcctcagctgggactacaggcacccaccaccacacctggctaatgttttgtatttttagtagagacggggtttcaccgtgttagccaggatggtctcgatctcctgacctcgtgatccacccgcctcagcctcccaaagtgctgggattacaggcgtgagccaccgcgcccggccagagtgattcattctaacattcaatgacctggcctcttagagtttctaaaccacttgactgttagttatatctactctaaggtgtctttttagccgcgttggaggaaatagacgtctttttgatctattcttcatcatttttgtataagtttgatatcctatgcagtcatatttagggatgctgaatagaaatgacttaaaaattatttttagaactgcatttctaggcatttgagtcttctgaaaactaagtctaagtcttctgaaaactagctttatcatcaaaactgaagaactgagtcatctaggaattgctgctttgctttaatgactgtaacaagatgagatgtgaataatttacaaactgacttctctaccagtcttctctctcactttgtcaaaatattttgatgtcctgacaaatactctttaaaacagtatctgcatagtgttttgccttgacaaagcacttttacacacattattcatttaattacaaatgatccccttgatttttttctgtgctcttccttttgtcccccaaaaacattattttaggaaaaattataccataactcagattcctagaatttattggttctttcaagaactttttttatgaagagcctactctatgttaagcatatgttagggaacaaaatgagtctctgcccctatggatgtttagattttagtgacagaaatacatagtaaacccataaattaatatatgaaattatgttgggtagtaagtgctatgaagagaaaataaacaaagcatgaatagagaaagattgaggagtactggcctatgtgaggaggttattttggggtaaagacttgtgtgaggccgggtgcagtggctcatgcctgtaatcccagcactttgggtggctgaaacaggcagatccctggacgtcaagagttcgaaaccagcctggccaacatagtgaaactacgtttctaccaaaaactagctgggcgtggtgacacgtgcctgtagtcccagctacccaggaggctgaggtaccagaatcgcttgaacttgggaggcggaggttgaagtgaaccaagattgtgccactgcactctagcctgggtggcagagtgagaccctgtctcaaaaaaacaaacaaacaaaacctgtgtgagtgagtaaaccatgcaaaaaccttgaatgaagaggattctaggcagaagaagcaccaaattcaaaagcccaatggtaagaacaggttttgagtgttgtagaaatagcaagatgagctgtgtatctcaagggaaataagatcagtagacagtgataggttctagaaagagggaaaggccagataatgaatggtcttgcaggccatagtttggaggtggattttattctgtgagtaaagagacatcactggaagtaaggaaacatcactggaaggctctcagcagggatgatgtgatctgatttatgtgtttagaagttgactcttgctgctatggagaattgactataaaaagagcgaaactgaagacacagaaaaggagggtggtggagtcatctcagaaggaaatgattacttggactagagtggaaatgataggtatggtgaataattatttgatcgaagatatatttggagggtagaattgatagaacttaagatagatagaatgtggagtttgagaggaagcaaagagtcaaggaaaattctgaggtcaatggcttgaacaaataaaataatgatgttgccatctgagaaagacttgggaatgatcacgtttgagtgtatgtgcttagaatgaaccagggttccatttttggattatgttgatagacagacacaaagggtatgattcagatattatttaccacttatacttgacaatctcaaattttggctcagtatcttgagaacatacacaaattaatttgtcacagggttttctaataatccattcatttctactaacatttcagaagtaatttccaaatcttaaagtttaggcttaatgacctaagacctaattccctaaatggccacgggaactagattgagttttcaccagtgatctctcaaggtcagctcagaacttaacaacattattgtcagtaggaagtaacttccccagtgattgttggaagcagcccagccttagaattaagagtcaaacagctgttcaagatgctgtgtgcgcagtaaactattcctccatagtatcacagacctgcaagcaggctggactattctagcccgtgcccttgatctcagagaatacaatctttgttttcaaagacttccagaaaaataaatctcaacacagagtttgttaaacacattttccccttatacactcaaaaatgttttttcattgactataattagatttttaaaaaaaaaacataatttcaggcctgaaatatgttcatttacttttcaattttacatcaaatttattcaatctcatttataaattaatattgttgttcatgttgttgactatctgaaacaatgaatggatgtatctgatacttcaatcccttatcttcacttttattcagaagtggagtgaaaataaggcggagctttttgtcatcttatttagatgattatttagtcaaactcatagaagcagagagtagaaaaatggttgccatacattgtaagggcgagttgttgctcaatggatataaagtttcagttatgcaagatgaaaaagttctagaggtctgctgcataacattgtgcctatagttaacaataccgatttgtgcacttaaaaatgtgttaaccgaggtccggagatcaagaccatcctggctaacacggtgaaaccccatctctactaaaaatacaaaaaaagaaaaaattagccgggcatggtagcaggcacctgtagtcccagctactcgggaggctgaggcaggagaatggcgtgaacctgggagacggagcttgcagtgagccgagatcgcgcaccactgcactccagcctgagtgacagagcgagactccgtctcaaaaaaaaaaaaaaatgtgttaacagggtaaagttcatattaagtgttcttatctcaataagaaaagatgattatggccttttctttatagcccagatacccatgttcataacttctgtaatactagctgtctcaaatgactattaagggaaacctctctttctgttgtttgctccattgcctctttcttcaaatttttttcttccatgaacccctatgaatttgctttagattactgggggcaatattcttgccaccctgccatgtacatcctggattgcttgcccttttccaagacctcgcttttaagttaactgagcattgcttgtcccgaagtgagcatttggtaaaatattcttatgtgtttgagactcaataaatatggtggctctttaaataaagaaggtccttttggtgacagaatatattcagcaactttcttgtcagacatagaaacaatacaggagacataaaaaataaggtagaaataacacaggaacaagaatgatgacgtaggatggcaaaactagtaaatacagatcaagttacagatatgactgttaacatcttgttctatgcctgctcggtatccatttgttgaatgaacagaactgttggatcatcctacatttcagagcctgtctagtgtcctctcatctcctacctaatcctgcagactacagaaaaagccccaagcagcagttcaaaccatggaacttctgagtgtttggacatgaaaatctcctttaagaaatcactaggttgaagaaggcaatgctaatgggaccacttcttgaggaaattccacccagtaactcagcagtgacactcagctttggatctggaacatgagtagacctagaataagatctgtccatttttcccaatttacagcattaattttttcacttatgattcatgagtccaggctttcccctgcaagcctgttttgcatctaaatcaacttggccttcatataacacactctagtgttctaactgggtgttctgtatcttagtcaacaatgtttactgagcatttactatatgccaagctatggctatggtttttaagcatcgataataacgatgcttagcagagactctcaaactgccaccatagagcaggcctgtggccgattaatgatcttaacaaattgattatagtatatgagaactggatgttagaacttagataaggttttagcaaatgcccacattttacaaatgaggacacagaggagcaggaagagtttatcaccttttctggatcactgcagccaggttctggcccagcccaggcttgaagcccaaggcttctgccactcagaacagtgctcttttcaccacttcagcctgcctcccaggatgattctaggaagttctgcttacaaatatgggtagtatttctagtcattccatcagattttattctgaaaaacacaaatttaccatttcaatatgaatacaggtaaaattcagcgccaggcaagctgtacatgattgaaagacatctgtgttttgaaaagcacgggcttttactcacatccatagtaatatgatcctaaatccactgtccccaggagaaagcaagatagcttttctccctgtcatgtcattacctatgcccagagttctcctcttgttcctctcatgaagcaaatcaatatctcacctttcatcccctccatacgtggttctgagctacttctatttatggcattatttagatatttttataatataagcaggaagcaagagggacagaaaaaaataatcagtggccaggtgtggtggctcacacttgtaatcccagcactttgcgaggccgaggcaaacggatcacctgaggtcaggagtttgagaccagcttgcccaacatagtgaaaccccgtctctactaaaaatacaaaaaattagcagggtgtggtggcgcgtgcctgtagtcccatctactcaggaggctgaggcaggagaatcacttgaacccaggaggcagaggttgcagtaagccgagatcgtgccactgcactccagactgggtgacagagcgagactccgtctcaaaaataaataaataaataaataaaaataataataatcaataacttggttcttctctattactttcaggaattttttaagtttctgatttcttccatggccattaggattttccacttatgtggcttccaaattattctaagtcagggagattttatgttttgttatcactcactttcagcttcactttagaattgcaagatttagattcaaagtgtgtaattaactgatggccttaggtaaaccctaacttatctgtatctcaatttgcatggatgaaacattcataatataaaagtatacaccacaaatatacctactcaaccaaactattggctccttaatgacaaagattaagtctctatatctttcctaactttgtacctaataggttcaaaataaatattttttgaatgaacaaattagtgagtcaacaatcagtcacccggttggccagtacctatggtgttttaagtgcaatctaccagataattcaaccttcataataaatagatttatcttgagattatcattgctataatagtgtagtagcatacttcatataagtttattttgtgaaccttaagaagctcaaggacaaacatctgtgtagtattcctaacattttctaaattgcatattttattttcatagaggtgctctacgtctttagtattgcttctaattctctcatatcactattttggacccttgggtctggctgtcttggaaaggtgaaaagaaaggtatggggaagaggatgtgttttaacaaagataattttatctgttcaagggattcaggaagtaattatcttaacatctgaatgctaacatctgaatattgtaaatacgtattctgtatgtacatgggagaaaatatctatatctgataccttttctatcatcacataaaggaactgacttctctggtttaaaatattaaccaaaatttatatgacaaaatcagtatatatgagtatatattttctcaaacctctttcaaacaggcctttttgggagacaagacacttatcaaaatcaaggctcttgacattaaatattcttgtttgtctttttttaaaaaaaagtcttcatttttctttcttttaaaatgcaataaattatactacaacatgcagtttatggtgagttattagatactgaaaaattggctttccattattttaatgcagattctacattgctttttttttactacataaagccatttgttttaagctccatgctacaaagaccacagatgttcattgcctagaacagtgtctgatacatagtagttgcttgaagtttgttaagtgactaaattaaagaggatcttacatataaccatgtttaaaattacatattgttatttatagtttttcccacatgataagaattattgccattttctttaacctctgacctccttgaaccaactatttctctctttttgtgggagttttatccttttgtatttaatctgaatcttttgaaattctaaagatacaatcacttaaccctctcttccatccactttcttttcttaatttcaggcaacaatgtgaaaataatggtgcttatgtctttgtaataacagaactttctttgtcttttctttggcctcattttaatcttcaatgactcatatttaagaaatgaactgtgcagctgtggtggatctaagtccttggcaacaactcgatgggcaaacacgtggtctctcacaatggatgctccttagctttgaattatttactgtccagttttaacaatggaattatatcatcaaatagtgccttggactttttaagtttttagtgccttaagtttttaagtttgatgagacctttaagatccatttccggccgggcgtggtggctcacgcctgtaatcccagcactttgggaggccaaggcgggcagatcacgaggttgggagatggagaccatcctggctaacacggtgaaaccccgtctctactaaaaatacaaaaaattagctgggcgtggtggcgggcgcctgtagtcccagctactcgggaggctgaggcaggagaatggcatgaacctgggaggtggagcttgcagtgagccgagattgcgccactgcactccagcctgggcgacagagcgagactccatctcaaaaaaaaaaaaaaaaaaaaaaaagatccatttccttattttacagaccttgttccaacaattatctccaccttctgtcaaggtcgtaacatatatctagggtgaccaactttcctcgttttcctgagactgtccaattttcctgaaactattctggttttaacatcgaaagtctctcatcctgaaaaactcaatgctggacaaaccaagatggttggttaccctactgctagcttccgtctttcactctaggttcaaatcattcctatgctaaaaagaacttcttatccctttgtcttgttatcctctctgtcctcctgtcgtgtcttcctcttttccttctcagaaaaagaaaattgaacatttgattttcacttgaaatacctactccttcttccactcactcctcagctatgcctacttctgaggcttctgccctccactgaaattgctctcagcacatctagtgaacactctgcaatgctgatcttactttacttctgtgtttcattggactcacttggtcaccctcttcctctcaaaattctcactctctccttgaaatttctacactcctcatttcccctaatctctccacctatttgttccttttctatctctcaagagatcctgttcctctgtttgcccattaaactttgatatgtaggcactcaacgtatattagctgaatgagaaaataactcctaagtattttttttctcctcaaacctcagaatttattatttccttgtggaaggaatgttagctttccaagctgagcatatcacagtcccttactctgtcccccatgcacagaacaccccccccacacacacacacacacaccatcatgttgcatttttaatattactcttcaataattttatcctgaatgagcatgaggggttctgaatcagaggcagatttcatttaattaccttacagtaaatattgttgctgtgcccttcctttgcccaaagacttacccctagggcaacatgatgaacgctgatgaaacattttcctacttgagtggctgggtactccataagtgggagactaggaaaaatcattttttctgcttataaaggagaaggaggctgctatccatctctcattctgaaaggttctctgtggaaacataacaggcctgagtcctaattccagcttctgcagaaaccagctagccctgtgtgtctcatgttttacaatctggaaatgtctccaaggtatgggcttcatattttttgaaatgtaaatacctagaaagatacccactccagtctttctaacaacatagagttcagcttaggaacctaccctgagctataaccgtttgaccctcttggatcagagaaatgaactagacaaattgctacagatctaatctccatggtgtgggaagtttctcaggaggctagagctttctgtaggtgaactgagacatccaggaaagtttatttcctcatacttagttgaattgcacccagcgtttgctcatctactcaacctagacactaagtgtcattcttgtttctttttctctcttctctccagcatctattcagtcaccaaattttcacacttcagatttttagacatttccctatcctatccctgtcatttttcctggtaccattgccctgagtcaaatcctcataatcttgcactgaattcttacaattgcctcattatctctctgattccatttctgttcttctcaaatacatactctgtatttatatcaggaagatctatttgaagcacacatattcctgtgccactcccttggttaaaaccgttcaaaggttcctgattaccttcaaggcaacacctaagcctcttagtggaccatatgtgatcatagagaggcagagcttcaaattctggtttaaaaatctaatgtatttccagatagcaatagtgtctttttcatctttggacatgccctctccttgttctttatgctctagaaacactggcctgcttgagattccgatacataccatactgcactatgtcctatgactctgcacttgcattttcctcttcttggaatgttctctagcatactcttccttgaataagtcatgttcatgcttttgaattctatgtgattactagcttctcctggaagcttttcccgattttcttccccatattgcgcaagtctatagcactgtctacattgtattgaaattatttacgtgtctgactcttctattatatgttaaatattcctaaatagaaagggctgttttgcattcaactttgtatttccagtttcaggtacaaccactgacacatggtagttcaatagagggagccattattatttttataattagtaatgtcagtattaattgcctcccttcaggtccaaacagagaaactaggcaaaatgataatttacttgaatttgggaaacttaattgtatgaaaaaaaacacaagaatacaacaactgaacacacacacacacacacacacacacacacacacacacacacaaacatggagatttcaagtgaaatatcaggagaatcagctttatatgtaagcagagtaaataactcacgtatctagcatgattttagggtacagaaatatcccattattcagaaagtacttccctatctgtaggctgaatcctaatattctacttacagaactccagtattttggttcaaacgccttccctttctctattgaattgtaaatagctgtggatgatgaatcattttgcaaagtatcagactcaggattcttttgaatggtgaacaccgctaagattttattaataaatgtgtcatacaatacagctctggaacacttctgtaacataatggcatatctgaaattcaaggaagaatactgctaatttgtttttccccagtgaaagaacagggcttaaattcagcaggcaacattgctaaaagacagagttgaaaaaagttacaaaaattaagccctagatcagggcaaatattactgttattgttaaacagttatattagcatttatgtagcatgcacttaatacttttattaataccctcacttctgagatcaaagaatctgggtcaataactctcttcaatggtgtcagagtatccgttaggttattctaggctcacggtatacctcacgatccttttagcactcgattatgtgtgaacttactgttttcactctgcttctagtgttaattttctcccttctttggatctagaaactttttgaaggcagaaactattcattttgtttttctcttgatcccctggataaaggaagattacagattaaagattaattctagatctgttcatttatagaaactagtgtccgcaattcctacatccataatagctcaaaacatttctactattctcaaagaggtcacaatggatgatgtaatgactatttttcaaaagtattgagacttttctcttagcttacctattttataccttgtcagacattttgacagaattaactggtgattgtcagttggattcattgtatactttaatatagcctaaggtcctgcaaatggcccttaaggcttcccattatgttctggatatccactatttggggtatgtttaagtcctcattagccatgctagagttttgcaatatataccttgaaactttagctgtagatttgaagtatggctgtcaggttacataaacaaagcactcttatctcaatgagagggcattaactatccagaatgctccccccatctccccagaatagctttacaaacacagcgctttcctcattaacagatagacccatatagcctttaaaaaaaatcattttataaccatcagtgtataaataaaagagatagaaattgacctgggagtttcataaacaagttctgagcacccaggattaattttgagaagaatgccacaagccaaataagcacttcttttcatctcatttcacaggccttcaagagggaattgaaaactaaagaacctgtaatcatgagtactcttgagactgtacgaatatttctgacagagcagcctttggaaggactagagaaactctaccaggagcccagaggtaattgaatgtggaactataataacatattgatagaaggatcagtggtgacggagcagcccatccattcttgctgccagggtctggatagctctcatattttcttggttaaatagaatcaattcaaattaaacatagatgctgaaaaaaaaataaggactcataaactaccatgcataaatcagtttgtgcattcataaataaacatcaaaagagattagcaatcagttattggaacatttagaaaataataaacaaagggagttatctgtgaggaggaattctattgttgcaaagactacaagttaattttccatttaagagcctgcctgaagtaaattagagcttgtggtatgcatcctaacgtttttctcctcaatagcttaagtgaatcttaaattgtcggattgatataaggtagaaactcaggaagatatactttagatgttctgggctgtatcaaaatttatgccaaagtataaaaaagccgttaatcagtaggttaccctcttgttcaactgtactctttctttcttccagtatgacctttttgacaatgtttaaaaaaaaagaatgtggcctaaaaccttgtcatattgccaatttagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggtaccgtctacttctttgcttcagggccctttgagagactcaaaagagcttctaatctgaacttgagtgcagtgttatcttcccacaaagttaaagctagagaaatcagtccgtctttcacaaattcagtcttcattcacatggtattttctccaagagaagacagtgatctaattatttgtctgtcttcagttatatgaaatgaaatattaaaacagttacagggcaagaaatcactttgactttgatattaagtgattgtactaaagtctgatgtgtgtgtgtgtgtgtgtgtgtgtgtgtgtgtgtattggtgtattgcttgtgttacttagtatcagaatacagaaaaataaaacacttaatcaaaagccaggagtctaggtgttggcccttttgctaaccaaattacatgacttgggtaagttatggtttggtgaaataaggctgttaatgtgttgcccttcccttggaaggcaacatttgtaatacagtttcaagtttcattggcccactgcagaaatgagggaaaatcattatatatttggaagaccactgtctataagaccaaagttaaattcccttgtggcacaaagatggcaaatatattctgtagaaaaaaatacatatttaggagtatcattttgaaatcagcaactactcatctattgtcaaaatcacaaaaatcctcctagattaaaattcaaaagaagttaaattccctcatgcactcagcatgtttgccagcatctcagcatcctcattctagaagttgtcctcttccttggctttcatggaactgttccatccatgttcttcttcctatatttttctagattcttctcctagccacccctcaaatactgttgtgcccaagtttctaaccttagcctaattctcttttgattgtttaaaccctccctgtttgagatggcctggatggtgatgtatctacatctctagtccgcatctctcttctgatctctgaatccatgtggcattacgatcacaaatgcaactattctgaaaccaagttcatttgttctcctgttttccatttccctacttctgtcccctcttatctgaccttttttttcctgtttcctatttcagttaatgaatcatcatccaacaaattttccaggctagaaactttaggttcatccttaaacccttctgcattttcactgatggcacatgatggctcatgttacctcagaatagctcttttgtgttttctctcctcttttaaccaatgtcctttttaatccccagcatcttttacttagatgataacagtatacatctttaaatcccattcacccctctgtgtgcctggcatatctcagatactgcattttaaacatttggtgaattaatggatggatgaatggtttctttgctgatgttcctgcattacccagcttcttccaattccaatccaaactccttgcgggagaatacttgcctagagaatgaaatccaatgaataaggagattacgtggcccttttcttcctagccttgacttaccttctcagccatagctcctattctccagaccatttaatacactctgcccatatgatatatatatatatgtgatggcatatttgggaaaaaggggtgatatgggcagagtgtattgaatgtgtgtgtctgtaaagtatgtgtgtgtgtgtgtgtatatatatatatatatatatatacacacacacacatacatagttagatatatacatagtatatatacatatatacatagatatacacatatatatacacatagatatagatatagatatatctgcctttgcaaatgctgttctctctgtctggatccccctacgttgtctacttggcgaattctccttcagccctcaaggaccagccaaaatgttacctatctttgttgtctttcctgagtgtctacaacccccaactcccaccaagcagaagaaactgcttacagttggtactctcatagatcaccaagcatgctaaattgtcacacttaaatttcacatatattgtagcaacttgcttatgcatttttttttctcccagagaaagtgaagttgctaagagcaaggatcatgctgtacatctttgggctgctagcccagggccagcaacatatgaggaatctcattaggtaccttcatttattcactcaacaactgtttatgagtcattatataatgtgctggacaggtagttataaaagaaacagacttgatcattgccttcatgaagcctatggtctaatgttgaattgcatagctcttcattaaaatagtaggtaaaatttttaaaaagaaaagattaaaaatttgactctaatacttgtaaaatcccttctaccccaatgttttatgaccccatgtctaacatttaaagtaagggttaaccttgctgtgtactggaaaactaagggttttgaaatgtattacctagtattttaaaagcattaaatatgttgattttattcaaaaatatagggactaattttttgacagacttctccaaaaatgagaaataagttaggaaaatgtcccagtggaactaaattagttaatatgtcaattaaattgctcaatagataggctgtagagcagacataagggattcatttttagccatacttgtcacacaggtgcatttgtaagatactgagtatggatggagaagagaatgtgtacagcataatttaataattaaaaataactaaaagcataacagttcaagtatcagctggccttcacccaaccctatttgcggtattccttttagtttccctgtcttatctgttcttggtcttaagacaaacttcattttccataccctgattggtaaaactctcattctgatcccaatgatagcaaaacatataaacattaaacatacctttcgaaaaattatatttataacccagcacatctatctttctcagacatatatacacttaagttatggtacttatctgaatttttatgtactggtaatagtagatgtgattgggcttttgaatctgtgttgtattttatgcgtgtttcaaactatgaattacatgaattcatatatatttatctcccttcggtagctcttctttaattttgcagtggaaataaatcatttttctccactgcatcttattgacactgggtttgaaactctgaagctttgggggtagtagtttacaaagaatgagttttattaactaaaatttatttcagaaaaaaagtagaagtgtacttgaaaccactcttcccatttttccactcagcaatttaagccctcagaggattcatgctgtagggaacttttctaataaaccatggtttctctttttttattttattttattttattttattttattttattttattttttttttgcgacagtctcgctctgtcacccaggctggagtgcagtggtgctatctcggctcactgcaacctccacctcctgggctcaagcagttctccgcctcagcctcccaaatagctgggactacaggcgcccaccaccatgcccagctatttttttttttttgtattttttagtagagatggggtttcaccatgttggccaggctagtctcgaacttctgacctcaggtgatccactcaccttggcctcccaaagtggattacagcactgataactaggcagctagctagaagaacattttatatatccatatcagttcattttccttacccctagacactctatcatagtaccccccctccattctgatcttatgtgttaaataacttgttattcaagaaactaagtaatatgtgtttctgtgagatttagcattctgtaattgtattagcaaatgtggcttttggatttaaagaatgggtgaaacaacaatgactaagtccctggcctttatggaaatggcattattgctagctgatcatctgcgggtggtgaacatggtaaattaataaatggaaacacaatattaatattgactatattgctcactaagagaatctcagccttccaaacatagcttccataggaaaaaacagtagaatcaaatttaagttttaaatgcttctttacttttaaaattcatgatttatactgcttatcaaatattttaagggcaagatcatgacttttcactttactgaaaatagcaccagtgcttatttgactagacaaatattctaccttccttgtaatggggaataggaataactttttgaattactaggtgttccacatagatctgtaagtggaatatataaaggctttaataaagtagaataacttttaaacctgtagtctggatacaagatttttgttcttcaggacaatcccaaggtgaaaaggtttgtggattgttgttttctttttttttttttttttgagacagagtctcactctgtcaccaggctggagtgcagtggtgagatctcggctcgctgaacctcctgggttcaagcaattctcctgcctcagcctcctgagtagctgggactacaggcgcgcaccaccacgcccagctgatttttgtaattttagtagagacggggtttcaccatgttggccaggatggtcttgatctcttgatctcgtgatccgcccaccttggcctcccaaagtgctgggattacaggcgtgagccaccgctcccggccagattgctgttttttaatgttttgtttttgttttaataaaccatggtttctctttttttaatttttttttttttgagacagtctcactctgtcacccaggctggagtgcagtggtgctgtctcggctcactgcaacctccgcctcctgggttcaagcaattctctgcctcagcctcctgagtagctgggattacagacatgtgccaccacgcctggctaattttttttttttttttggattttttagtagagatggggtttcaccacgttggccaggctggtctcgaacttctgacctcaggtgatccgttcaccttggcctcccaaagtgctgggattacaggcgtgagccactgcgcccagactataaaccatagtttctctgtaccaaaagtggtatgtccttcttgagccaggaatatttcactgttcttagtttacctgttgactctgaacacagtttttcatacactgtaaataactctcccaggctgccatcttggaatatgcaaatctgtcgcatctatgtagttatgcatatcgcatttttgtcaaacttttaacttgcatttcttactgtgaaaagtcagggcagggattctatgagttttttctttaaagttcctacaatgaaatgttttgattaaaccttttttggcattcaaattgagattgatttaatgatgtgtgtagtaggctagaaattatgatgaagtgacgatgccatccttatttatcttcagcattcacatctaaagttttaagaagaaaactggcaaatccacctttttaggcttaccatcctcagtccctgtggctttgggtttttttgagaaatttgtcaaagaaacgctatgttagaatttgacattgaggaagccaagcatatttcctctgaatagataatgtgaaatgtgatataatgtattagaatttcatcttcactttggcaagcaagatacttgcaaccatgttcatgcaactatcttcccttattgcttttctcttcttaaccttggttctaaagttttcttcttattgtattaattttgttatgcttcccatttatatgagtcaagtcaaccttacttgatttcttatatatgagttatgtaaggaaaacttatcttttcttatagaattaggggatgaatgagcagatagaaccaacatgaacagggcgatcctaaaaatcattcaaaacatgtaagctctcccaactctgaataaacttgtgatatcttcataatgaataaggtatactgcctatagtaggaagaggaaaatttattaatgttttgtgcattgttaaagaactacaaatgaattgccgtgtggaggctttcattgttgttgttgtaaaaatgctatgtgtattaagtaagcctttgatggagaagaaaaaacaaagaaaaaatatttaatccttcataaatctgggttaaatatgaagctaattcctgttatttggagtaaccagggttttatctagtttacaaagcatgcaattgcaatgtttaaaagcatatgatttggcctttaatatctgaaaatatgtctatcaaaggccatattatagcgagtgtcactccatactttataagtacggtatatttttaatagaatgtttatgtactggtgataagagatgttactgggtttctaaaccagtactgtattaaggattttatgctattgtaagattatggattatgtgaattcatatatattgatttactttcagtagcttttcaatagaatatctagggtttaatacagcttagaaactaaagcaggaattattcatctttaaaatcctgaccaaagaagtggctggcaagatggctgaataggaacagctcaggtgcgcagcccctagtgagatcaacacagaaggtgggtgatttctgcatttccaactgcagtacccggctcatctcactgggactggttagacagtgggtgcagcccacagagggcgcagaagcacggtgggatgtcgcctcaccccggaagcacaaggggtcagggaattccctcccctagccaacagaagccgtgagggactgtgccctgaggaacggagcattccagcccagacactatgcttttcccacagcctccgcaacatgcagaccaggagattccctcgggtgcctacgccaccagggccctgggtttcaagcacaaaattgggcagctgtttgggcagacaccgagctagctgcaggcgtttttttcatatcccagcgtcacctggaacaccagcgagatagaaccattcactcccctggaaaggggactgaagtcagggagccaagtggtctagctcagtggatcccacccccaacggagcccagccagctaagatccactggcttgaaattctcgctgccagcacagcagtctgaagtggacctgggatactcaagcttagtgtggggaggggcacctgccattactgaagcttgagtaggcagttttcccctcacagtgtaaacaaagccgtcaagaagttctaactgggcggagctcaccgcagctcggcaaagccactgtagccagattgcctctctagattccttctctctgggcagggcatctctgaaagaaaggcagcagccccagtcaggggcttatagataaaactcccatctccctgggacagagcaccacggggaaggggcagctgtgggtgcagcatcagcagacttaaacgttcctgcctgctggctctgaagagagcagcagatctcccagcacagcactcgagctctgctaagggacagactgccttctcaagtggggtcctgacccccgtgcctcctgactgggagacacctcccagcaggggttgacagacaccctcatacaggagagctctggctggcatctggcaggtgcccctctgggatgaagcttccagaggaaggaacagacagcaatctttgctgttctgcagcttctgctggtgatactcaggcaaacagggtctggagtggacctccagcaaattccagcagacctgcagcagagggttcctgactgctagcatcaacatcaacaaaaaggacgtccacacaaaaaccccatctgaaggtcaccaacatcaaagaccaaaggtagataaatccacgaagatgaggaaaaaccagcacaaaaagcctgaaaattccaaaaaccggaacgcctcttctcctccaaatgatcacaactcctctccagcaagggaacaaaactggatggagaatgagtttgacgaattgacggaagtaggcttcagaaggtgggtaataacaaactcttacgagctaaaggagcgtgttctaacccaatgcaaggaagctaagaaccttaaaaaaaaggttagaggaattgctaactagaataaccagtttagagaggaacataaatgacctgaaggagctgagaaacacagcacgagaactttgtgaagcatacacaagtatcaatagccaaatcgaccaagcaaaagaaaggatatcagagactgaagatcaacttaatgaaataaagcatgaagagaagattactgaaaaaagaatgaaaaggaacaaacaaagccttcaagaaatatgggacgatgtgaaaagaccaaacctacatttgattggtgtacctgaaagtgatggggagaatggaaccaagttggaaaacactcttcaggttattatccaggagaacttccccaacctagcaagacaggccaacattcaaattcaggaaatatggagaacaccacaaagatactccttgagaagagcaacccaagacacataataatcggattcaccaaggttgaaatgaaggaaaaaatgttaagggcagccagagagaaaggtcaggctaccccaaaggaaagcccatcagactaacagcggatcatttggcagaaaccctacaagccagaagagagtgggggccaatattcaacattcttaaagaaaagaattttcaacccagaatttcatatccagccaaactaagcttcataagcaaagtagaaataaaatcctttacagacaagcaaatgctgagagattttgtcaccaccaggcctgccttacaagagcttctaatgaaggaagcactaaatatggaaaggaaaaactggtaccagccatggtaaaaacataacaaattgtaaagaccatcacactatgaagaaactgcatcaactaacgggcaaagtaaccagctagcatcataatgacaggatcaaattcacacataacaatattaaccttaaatgtaaacaggctaaatgccccaattaaaagacacagactggcaaattggataaagactcaagacccatcagtgtgctgtattcagaagacccacctcatgtgcagagacacacataggctcaaaataaagggatcgatgaatatttaccaagcagcaaatggaaagaaaaaaaaagcaggggttgcaatcctagtctcagacaaaacagactttaaaccaataaagatcaaaaaggacaaaaaaaatggtattacataatggtaaagtgatcaatgcaacaagaagagctaactatcctaaatatatatgcacccaatataggagcacccggattcataaagtaagttcttagagacctacaaagagacatagatgcccatacaataatagtgggagattttaacaccccactgtcaatattagacggatcaacgaaacagaaaattaacaaggatattcaggacttaaactcagctctggaccaagtggacttaatagacatctacagaactccccaccccaaatcaacagaatatacattattctcagcaccacatcacacttattataaaattgaccacataattggaagtaaaacactcctcagcaaatgcaaaaaaacagaaatcataagagtctctcagaccacagtacaatcaaattagaactcaggattaagaaactcactcaaaaccacacaactacatggaaactgagcaacctgctcctgaatgactgctggataaataaggaaattaaggcagaaatgaataagttctttcaaaccaatgagaataaatacacaacggaccagaatctctgggacacagctaaagcagtatttagagggaaatttacagcattaaaatccccacaggagaaagcaggaaatatctaaaattgacaccttaacatcacaattaaaagaagtagagaagcaagagcaaacaaattccaaagctagcagaagagaagaaataactacgatcagagcagaactgaaggagatagagacatgagaaatccttcaaaaaatcaatgaagccaggggctggttttttgaaaagattaacaaaatagatagactgctagccagactaataaagaagaaaagagagaagaatcagacagacacaagaaaaaatgataaaggggatattagctctcatcccacagaaatacaaactaccatcagagaatactataaacacctctacgcaaataaactagaaaatctagaagaaattgattaatttctggacacatacaccctcccaagactaaaccaggaagaaatcgaatccctgaatagaccaataacgagttctgaaattgaggcagtaattaatagcctaccaaccaaaaaaagcccaggaacagatggattcacagctgaattctaccagaggtacaaagaggagctggtaccattccttctgaaactattctaaacaataggaaaagagggactcctccctaactctttttatgaggccagcatcatcctgataccaaaacctggcagagacacaacagacaaagaaaatttcaggccaatatccctgatgaacatcaatgcgaaaatcctcaataaaatactggcaaaccgaatccagcagcacatgaaaaagcttatccagcatgatcaagttggcttcatccctgggatgccaggctggttcaacatacagaaatcaataaacataatccatcacttaaacagaaccaatgacaaaaaccacatgattatctcaatagaagcggaaaaggccttcaataaaattcaacaccccttcatgctaaaaactctcaataaattaggtactgatggaacgtatctcaaaataataagagctacttatgacaaacccacagccattatcatactgaatgggcaaaagctggaagcactccctttaaaaaccggcacaagacaaggatgccctctcccaccactcgtattcaacataatattggaagttttggccaggacaatcaggcaagggaaagaaataaagggtattcaaataggaagagaggaagtcagattgtctctgtttgcagctgacatgattgtatatttagaaaaccccatcgtctcaacccaaaatcttcttaagctgataagcaacttcagcaaagtctcaggatacaaaatcaatgtggaaaaatagtaagcattcctatacgccaataatagacaaagagagtgccaaatcatgagtgaattcccattcacaattgcttcaaagagaataaaatacctaggaatacaacttagaagggatgtgaaagacctcttcaaggagaactacaaaccactgctcaaggaaatgagagaggacaccacaaacaaatggaagaacattccatgctcatggataggaagaatcaatatcgtgaaaatggccatactgtccaaagtaatttatagattcaatgcagtctccatcaagctaccattgactttcttcacataattagaaaaactactttaaatttcatatggaaccaaaaaagagcccacatagccaagtcaatcctaagcaaaaagaacaaagctggaggcatcatgctacctgacttcaaactatactacaaggcttcagtaaccaaaacagtatggtattggtaccaaaacagatatatagaccaatggaacagaggcctcagaaataatgccacacatctacaaccatctgatctttgacaaacctgacaaaaacaagcaatggagaaaggattccctattcagtaaatggtgctgggtaaaccggctagccatctacagaaaactgaaactggaccccttccttacaccttatacaaaaattaactcaagacttaaacataaaacctaaaaccataaaaaccctagaagaaaacctaggcaataccattcaggatataggcatgggcaaagacttcacgactaaaacaccaaaagcaatggcaacaaaagccaaaattgacaaatggaatctaattaaactaaagagcttctgcacagcaaaagaaactatcatcagagtgaacaagcaacctacagaatgggagaaaatgtttgccatctattcatctgacaaagggctgatatccagaatctacaaggaacttaaacaaatttacaagaaaaaacctaatcaaaaattgggcaaaggatatgaacagacacttctcaaagtaagacatttatgcggccaacaaacatgaaaaaaagctcatcatcactggtgattagagaaatgcaaatcaaaacacaccagttacaatggcgatcattaaaaagtcaggaaacatcaggtgctggggaagatgtggagaaataggtgtgcttttacactgttggtgggagtgtaaattagttcaaccattgtggaagacagtgtggcaattcctcaaggatctagaaccagaagtaccatttgatccagcaatcccattactggttatatacccaaaggattataaatcattctactataaagacacatgcacatgtatgtttgttgcagcactgttcacaatagcaaagacttggaaccaacccaaatgctcatcaatgatagactggataaagaaaacgtggcacagatacaccatggaatactatgcagccataagaaaggatgagttcatgtccttggcagggacatggatgaagctggaagccatcaatctcagcaaactaacacaggaacagaaaaccaggcaccgcatgttctcactcgtaagtgggagttgaacaacgagagcccatggacacagggacgggaacatcacacaccggggcctgtcgaggggtgggaggttaggggagggatagcagtaagagaaatacctaatgtagatgacaggttgatgggtgcagcaaaccaccatggcatgtgtatacctatgtaacaaacctgcacgttctgcacatgtatcccagaacttaaagtataataataataaaaaaaaaatcctgaccaaattatttattcaatgtgaaattaattgtaagttagtgttgccaggagagcttattacttagttaccatgtattccctctcatctcctgctttgtttataaagctaaaagcaaattacttaggacagcaatgtcaaatcactttctttccccaaagcatctgattttagatagcgctgtgtgtgttttaaaagcccctacctcgacttaggcaaacagaaccttcgtttaccatgctattcccatcccgcctttgaaacttctgaaaaggcagagcggagtaattgtttcagacatctgcttagcatactttgaagtgcatataagttctttttcagtttcatttgaaccccagctgtcttcaccgaagtctataatcaatctgaattaagttgtcctacttctcctaataagtctcttattaagttctgcatcagcctcttagggagacttaaaagctaattcatgtagaattgccattttctactaattcacttgtcagctctccaaattccaacaaaaacaattgcaaagactattaatttggctcttcataaacaacttatgtaagtgtagtatacattggaaccaaacaaacgatttaaaacagtgggtgggaggaaatgagttgatggcattcaaaacgcttccttttttgactgttatgaaatgccttccacatcgaaagcataaagccatttatttaataagggaaacatccttctgcttttactttcatagatgagataatgactgaatgaactttgcttaaagacaggaaaaggctttagaacagttggaaaaggaacatgttctttttgtcattgaacttattttaatttggacttctttgtgttattttgatggactgtgataaaagaaggagctagaattggttattattgttattggattaaatcagagttgtacagctactcttctggtcatgggatatttaggagaacacgggtaatcaaaatgttcagctaatgagttcatctgattctactcaagaagtgtttaatcagataataaaaatttctccaaataataccatccttcctactatttgaaaacaaccatatcaacatctgatcctataatatgccaatcctgtttgctaggattttctgaaagctttgtttgtggtgggtaataactagaaatactattcctcaagagtctcgggtaataaaagattattcaaaaaacttaagtaatatactctcagtattagaggatatacaaatgcactcattcattaattcatgatatgattgaaacctatacccagagaagtctgatctcattatagagtgtgaacatttaatttatttcaaaaacaaaaattatattgagagttgtatagatggcatcttagttttcctgggaatattattatttagcaccaagctgagggagcaagaatttgtattagcttgtgtatacatgtgcatgtaccacattaactagaaacagtgctaaaatgtgagttatttatttaactgaaattccatatttcctaagaaaatggaatcacacagccaatatatatttttaattattttttgacatctaccaaagttgtgacaagaataaagttcacaattctgttactctcctaccgttcagtaaaacaggaaatgctttaagatcaaataacccaaggagttcgcttcttcctgtcatgcttgacaattacaattttcaaaatttaacagttagcattgacaccagtattatgccttacacaacctgaaattaactaagttaagtaatggcattgaataatttttcttggtaaatcagttttctgggtattatgggaacagttgtgtctgtgatactaatgtctctctcattttaatggggcctaagaaagaactttttcataataagattttttcatgttaaaataatatttttagttatagtttacacttactgcaggtttttctatttaaaagcatcttccgagagcagtgattcttaaacttatttacttcagttatcttaacagcatagaagacatagcctgacatctcccgcttccacttacctatctcctttttccatgagcatgaaatttctttgatgttcttgttttattttttaaatctcacatcaattttatggtattttccataatggattcatcatgttttaatatgaagatgctttttcttcaaattctgaagtaaggaatctttcagcacattcacctatggacatgaaagcgtaagttgagaatcacagtataaaggattgcccagtttttgcaggctttatctttttccatcaacttctgtcttttatgtacacagacaaaaagagcagacccttgctatttcaaatttatcttttgcaggttcatctgattattgtgatccaaagttccatgactagcagctcttaattttgaacatgtattatttcaagcttttgtgcatagtcacttaactaatgagttaaatggcattttaagtcaggttccatgaacgcagaccctgagaacaggggtctaggtgcctgtgatttatagagggtctgctctcaggagaagcctgtattggagttagggaaacaatacaggagaagaaagagcccagcaagtatgccatttcaggtgaaacctcacattgtgtctgatccagagagagagcaagccctcgagcagaaacctcgctgtggagttgtactctttattttattttatttttttgagatggagtttcgctcttgttgcccaggctggagtgcaatctcagctcactgcaacctccgcctcccaggttcaagtgattctcctgcctcagcctcctgagtagctgggattacaggcatgcaccgccacgcctggctaatttttgtgtttttagtagagatggggtttcaccatgttagtcaggctggtcttgaactcctgacctcaggtgatctgcccacctcagcctcccaaagtgctgggattacaggcgtaagccacaacaccgagccggagttgtgcctttataccagtcattgtctgtgtcactgaagtgctggcaaatatttgtcgactagctctgaggtgggatgaatcctggtgtgtatcaaaaccagttttcgtggtgtaaatactccctctaccactgatctccagctaccgacataatgccactgagtatggaattgggaggagatgcacacaattggctcttgggctctgctgcagcacaccactggctgtggtccactcctgggatatgggttacttcctgggctagggggctcccataagcagaggtcacatgtggagaaggcaggtagctataagacattaatagtcaaccatcacagcagctgaaggatggatgcccaggttaggtaaagtgtcccctgcaactaataagtaaacctagtaatccactcactcttcatattcaacttggctttttttaatgctgttttgtttttgcatgtacagtaattctttataaataatgagaattttgtttctttatggaaaatccacctaccctccaccctaccatgaatagcttgatagctgttcatcagaattagtgatggaagagaagagttaatgaatgaaaaagtctaagaaagtgatcactattagtaagaaaatggcctcataagtgagtttggctttatagttatggaatctgtaaatgtctaggcattcagacatgtccagacatcattgagaatgtcaagaattttcagtggcaatggttctcacctcagcatacatcagaatcacctggagggcttgtagaaactcaggttggtgaaccccttccccagagttcctgattcaaaatgtctggggcaaggctaagaagtcccaacttgttcccaggtgttcatgatgctgctggttcagagatacattctgagaaccaatattccatagtaaagctactgtgtatgtacctgaagacatattttgtgtagtgttagcgtttcttcaattacaagtaataaatatatcatttattatttcttttatatttatcaatatccagaagatttagtttaaaaatgaatgcaggcacacagcctcttgttggattgattaatagtttagatatgggagcatcatagggagcattgtttcgcttaggaaccttgaaatgaataaatggcttcttttctaaatctcacttgtggaagactttgacggtggtttatttcattttttcctgttggtattttaatgacactggtacaattttggggttgcttcagatgaccaacagcataacttgccttcccagtattaatttttaacgttaaaaatatttagtcatggccggccgtggtggctcacgcctgtaatcccagcactttgggaggccgaggtgggtgggttgcatgagctcaggagtttaagaccagcctggacaacatagtgaaacctcgtttggacaaaaaatacaaaaattaaccaggtgtggtggcatgtgtctgtagtcccagctacccgaaaggctggggcaggaggactgtttgagcacaggaggttgaggctgcagtgtgccctgttcactccactgtactccaggctgagtgacaaagcaagaccttgtctcaaactatatatatatttagtcacataacttttcactttgtgtaaatattttttgcatttaccaataaaaacaattacatttaaaaattctccttacacttttctaccaaacatactgatgataaaatagtactttatagagtttctgaatctaggatattaaaaatagttgggatcagtcaacactttttaagtaaaatctacttgctagatatgaatagctaacagcttctccaggagtgcctacattttataacttactttgtccaccccttgaggctctgtgttcagggggagggtatatttttgtgtatagaaatagagatgaggtgaaatagagatgaaatagagatgatgtgggatcaactgggagaaagtagaaaagagtcttagctgaagtggttgaggaaggaggatttttcccaaaatggtgcaaaaaacaatgtattaaatatctgtgaaaaagttcatggttgtggtatagggtgagtggtatatgaaaagagaattatgggataaactaatggaaacagatgtcttaaaatttgcttttaactttaaacaagagacatgaaacttaaacttttcccttatcctagaatctgggagaggagaaggatgagaaaaaatgaaattttacattagaagcaatttgattaatgttcaatggaaaatggaaatagctatggtcaaacccactcaaatcaagtgtacattaaataattgagttaactgaattaggcagagtaagggcacattgattttcagtgttgttgaaaattggtccacatatcattgttatgctttttgtttgtaaacctcaatatttattaagtttccacagtgtgctcagccctgaaacgccaaattctcttaaccagaatgaggctggaggatctaacactaagacagatttctattttcttttaaggaattgatttttatggtaattttttttcttcataaagttaagaacctgccagtcctgtttcgaaacacacttatttttagaagtttggttttccgggattatgcatcattatagactcaaatgactcatttagaacttttccctatcaaatattcacattctatcatcatgatcttaacacggcataagcaagttagtgaacagagtgaagtcaatttattggcaatatatgccgaagtacaggaattaagtagaaacaaaagtgaatgagagtctttggcaatacattgatgtgttttttttagaaccaatgataaactactgctgagtttcctttcatttacttttttcctactcttaaaacattgtaacccattttgagatctatccattgttgtgaacctaaagcctattaggtcttattaaataatacccatttaactgacctgtgatttaagtttcttatctgcccccaagcaagcagactgtatgcaacggcattttacctgcttcaccttctgcttgccagttggtttttggtcttcacatgtttctagcagggatggggctaaagcaagggagagaatggtccattgttttagactttcacaaacccaatatactagaatctccacaaaggttatccaatatcagggtgacttttgtgcatccaataaagcataaggttaaaagaaatacaggctaaacaaatgagcataaattactccgttggcttatgctgtgaataaaatattacctttggaaccatctcaattttttttttgtataaaggttgaaggaagacatttgcaaagtcgtttctcctataaaactgcctagggtttggggttgattgttgtatgcaagaggggtcttggtgaaatctgacccactttgaatctaaaattactgaattattagtgaaaagattattttaaaaagagttttgaactctttttcctactgaaattgtattctcctttagataatcaatgcagcatcacccccacagatttttgagggcactaaatcatactcctattttgaaaaagaaaaaagtctattactattaaatatatctgttagttgaatatcaatcactttttctaaagggtagatttggccaatgagtgatttttttttttttttttttttggaaatcacatctgagaacgttgtttagacagcttgacacttagactcatttgtgtaagtagtaatttattcatcatttgcatgtacttaactggacattatcatgatagcagttgtcataacagactattacaggatatgaatttagatattaccttaagatgtgatcataaaaatcagaataatatcttgaaaatatcaattttatggtgagaaaaatgacaaactgaataaactcttgactcaagaagctagacttttcacaacctcatgtattcacagaagtaaaaataacaactaataatgtgtccagagggcccacattgctcagaaatgaatacataagactttcttttcagcctcagaatatgatgaaaagaagatgaaccattatgatgttgcatagattttaatgaagaaaattcgttttctgttcctttcgtttgactttaagtagttgaacatcctgcttttttattttgtttgcaagaaataagaccattttagaaaggctaaaaacattaattacatttaggaactacaataatctgaaagtaaaattggatattaaaggacgtttttgcaatcctttttagccctcttctgtgtattatttttatcactgctcttaaaaatttgtattaatctttggttcatttctgccttagtatttctaagttaataatatattgaatgaaaaatcaaatcagtaaaaatccattttgtttcagtagtgagtgccttccccctagaaccaaaactaaataaatgtgctccatataaagcaaaccaggtacagcatattgcacgggtaactcacaattctagattcctctattaatcattattcagacatgcagaggtagcttaatttgctttaataagtgaaaacagaatctctttgagactgctatctgcaatattatactttgtcctgcattttcttggtcaaaaattgtattttatagccatgatatattttggcttggaatttgcttctttataagcctagttattaatagtcatcatttaaatgaaatgatatccattagccttaagctgcatgattacagagacttggtctatcttacgctgtatttccagtgcctagaacattccctggcatataataggtacccaataatagtttttggaataaatgaataaacaaatttgtgcaaaagcatagggcaaaatgctatcttttagatagcgtgacccttaaaaattattttgcaaataatttgctccatttgccaccagcttatttctggccattgttacttcttgtctctgcatacaaacactctgtgtctcttctcctttccacaatgaccacaagttatactgatctacttgagattttccaggtgactatttcatgtccagaggaacatgcctcttctagtgttcccctctgtgaatgatttcagtcaccttatctactcaggaggtctctcttcccctccatcagcatctttctctgcaccttccaaacccctatgactcaacttctcataatatggattgcattttttttaatgacccattaaattgtgtacctctgctaatgattgtgagtgtgttgagacttccatttttccagtggatgataggtatataatatatatatatatacacacacacacacacacacacacacacacacacacacacatatatgtgggcacagtatctagtggatataaagtaagtgttttcaagtgagtagtaattaaatctaagagttgccgagaaaatgccattcccgttttgtggacatcttcattctacattgtaaaggccacctcattcaagacccaccacaatcttgatcccagaaaacacccatgattcatcttttacagctgccctgtacttcatattttaagttattaaaggctatttgcttttcctcagacacacattaaactttcctacctcttaccctttgttcaagttctgaacacatatctttcttccccacactatgcttcctctttatcagtttcatgtacctactttccaatgtctagttcgaggagacgtttataaggctacatgatagaggttgcccctggggcgatgtgagaaatcagctccaaaaaggtagctacccggcaaaggatcttagtctgtgactctctcatggatgaacttattacctactgctttgcagagtctccctggactagcctgaataggaacttgtgtgactatatgtgaactaaaagaaggagaaatatgcctaaacttctcatccatctttgtaacagccctaaagtatgcatgttactatcccttttctacacaagtggaaaatatttgtaaatgaacttcgttacagtctaatatttgatgacttcttagttcatatcattatttaagtaacttttctttagtggaaaagcccaaaaattagggaggcagggagagagagagagagagagagagggatcatctgtaatctcagccccagcatctataatcccaatccctgcaagggcctctttgggcaaagaagaaaaaggcactgtgtttttgaagagatccccggtcctatgccaagcctaaccaatttggtagtagagcccaggctggatttcagttggtttgtagtcttctagtcttttcatatgtaaatatttttaatgcttttattcagtgttgttaaaatgccctccaaaagatgcactaacttgtgccaccaccaccaagcagaatatattttccttgaataggctacttcctctttttttcccactcactccatttttattttaaaaatccctggtagagaccaaaaactgaaatgttatattcttgcccaaagaatgagagatgcttcagaaattagcaaatgctccaatataaatcaagtgatagatataaataattcagatatgggataaggaaaatgggtagctttctcttatttaggaactctatgtcaggtttctgtgagaaactgtttacgaagcagtctgacaatagctattggtctgaagtattagtaattagtacagaagtgcctaattctcttgactgcttgttctttaataaaaatgtattgagggattatcatgtactatggcttggcatatactggtgaaaaacaataatgtaggattgccttaataaattttctggtcttgggaaggaacagacaatgaataaatgaataggcaaatatatatgtacttgcaaattgtgatcagggttcagaaggaaaatagggtgttgagagtcaaggaaaaaggagacactttacgtagggcaaccaactgggaataggctatctttaaaagtcacatctaactgagatcagaagtatatgaataagagccagctaggcataaagtggatatataaaactccaagcagagggaacagtgtatctgaaggttctaagtcaagagtaagcttgggccaggcacggtggctcatgcttgtaatcccaacactttgggaggccgaagtgggaggatcacttgagcccaggagtttgagaccagcctggaaaacatagagagatcccatctcgcaaaaaaaaaaaaaaaaaagaaaaagaaaaaactaacttaaaaatatatatatatcaatgccagtggtgtgtgcttgtagtcctggctaacttgggaggctgaagcaggaggatcgcttgagcccaggagtttgaggctgcagtgagctatgatcgcactgctgcactccagcctgggcgacagaaagaggccctgtctgaaaaataaaataaaaataaataaagaaataaaaagcttgatgagttctaggaactcaacattttctaacttcttattagaaatgccaaattctcaggcccaccttacacccactgaatcaaaagcactaagtgggactcagcagtctctgtgttaacaagccttccacatgacaatgagatgcacactattgtgtgagaatcactgccttagactgatgttttgagctatttaggggagggagagggcccattcagggacaatggtggttaacacatgtggctcagaccaagaaatgattgcaagcccaaaaacttgttaaatgtaaaacttcaggcgcagtggctcacgcctgtaatcccagcactttgggaggccgaggcgggtggatcatctgatgtcaggagttcaagaccagcctggccaacaaggtgaaacccagtctctagtaaaaatagaaaaattagccaggcatggtggtggtgtgcgcctgtaatcccagctacttgggaggttgaagcaggagaatcgcttgaacccacgaggcggaggttgcagtgagcccagatcgcaccattgcactccagccggggcgacaagagcaaaactctatctcaaaaaaaaagtaaaacttcatctgtctgaagtaacttctgaatttgaagataaacatcctcatggttgatattttaatggtttatggattattacttacttttaaggaagttaataggtttcattaactgccattttgcttcattttgtcacatataattaaaatttttcagacagaaaatattggtattttttctgtttccttagcaacctaaagcatgacctgcttaaatgacttatttgtgctcattaaaagcctttttgtgttaattgtgtatattttgtatttagcctctgtgaaacactcatgaactatctttttatttgttttaattgtgtcattggaaagcttgaagtattttgtggtttttttttttttttttttttttttgcttgttttttgtctataaaggggagataactggcagttgcagttaggattatagaaacattttcccaaggaaattaataaaatttgttcaagtttcttcttttacaaattgtacttatttttgattttttaaatagtggtaaaatacaaattacatgaagtttactatcttggctctatttaaatgtatacttccatggcattacatacatttacgttgttctgctgccatcaccaccatccatctccagaactcttctcatcttgcaaaactgaaactctatgtctattcaacgataatccccaccaggcatggtggctcacacctgtaatctcaacactttgggaggccaaggcaggcggatcacctgaggccaggagttcgagaccagcctggccaacatggtaaaaccccatctctactaaaaatacaaaaattagctgggcgtggtggtgcacacctgtaatcccagctacttgggaggctgaggcagcagaattgcttgaacctgggaggcggaggttgcagtgagctgagatcgagatcacaccactgcactccagcctgggcaacagagcgagactccatctcaaaaggaacaaaaaagaaaaaaccacagtaattccccattgcttcctgcccccagcccctggaaaccaccattctatttcctgtctataaatctgaatactcatttctatatcttctttggagaaatgtctattcaggttacttgctcattttttagtcaggtgatttgttttcttgctattgagttgtaggagttccttgtgtattttgaatactgaccccttaccgggtgtatggtttgcaaaatatcaattgctcctgctatgttcaacttgttcttaaaaataaaaacttttcctttgtggtcaatacttccctgttcctcatttccaaattttatacatgaaggaaatgtgagcacccagaaaagaaagaagatagacactgttaatatggccaagatataattcggcttttattataagaacattggagttacaagcttcatagaaagccatgtcctaaaagatgaagaattatgatcagtgcaaagagaaaatgttaaaaagaaaaagttatccttttatgtttgggtatatattctttttcgatattgtaaagagaaactagagttttttgttcttgtttttgagacagagttttgctcttgttgcccaggctggagtgcaatgttgcaatctcagctcactgcaacctccacctcccgggttcaagcaattctcctgcctcagcctccagagtggctgggattacaggtgtgcaccaccatgcccggctaatttttctgtttttagtagagacagggtttcactgtgttggccaggctcgtctgtaactcctgacctcaggtgatccacccacctcagcctcccaaagtgctaggattacaggcgtgagccaccgcacctggttgagattgttttttataaaaagatgtggattctttatggaaaacacagagcagttaattgctatttttttaatgtcacaaatttggaagcgtgttgagtctgagaagaaaccatagttaaaatataattactgataatcgcttgggaaataaaagccctaaatttcttcatgcctacaaacttaatattgttttcccaagatcttttttttgactttaacctttcttaagtgtttctgattatgctaaatctaggccattagttctgagtctgtttcattatttatattgttattcagtttactcgtcaaaagtgatcatgcccaaatatgaaagtttacaagaattgccctgaaaactgaacggaaggagacaacgaaaagaaactgcataatattttgccttcaggctatcacaataaaaactgttgctggaaaaaaatgcaatcacatcccttttttttttttaaagtacgtttcaatggcataatttattgtcgagaatgtctctaccagaagcataagtgatactaaaggcagagggttgtattcgctcagtctgcaaagtatcccctttgtcttagctccacacagtccctcagaatttggcagaaatgagggactcaactttcgagaaagggtgacaatcccagttttgttggagagctatgaaatagccccatagtgttagtaatgaaaattcacttaagaagtctcctgcaggcccggcacggtggctcaggcctgtaatcccagcactttgggaggcctacgtgggtggatcacctgaggtcaagagttcaagaccagcctggccaacatggtgaaaccccatctcttctaaaaatacaaaattagccaggcgtggtggcgggcacctgtaatcccagctactcaggaggctgaggcaggagaatcacttgaacccaggaggtagaagttgcagtgagccgagatcgtgccattgtactccagcctgggcagcaagagtgaaactccaccttggaaaaaaaaaaaaaaaaaggaaagaaaggaaggaaaggaaggaaggaaggaaggaaagaaaaaagagaaagaagtctcttgaaaaaaagaaaggaagaaagaaagaaagaaagaagtctcctgtataaaaaaaggaaagaaagaaaagaaggaaggaaggaagaaaagaaaagaaaagtctcctgaaaaaaaaaaaaaaacaaaatataagtgcttgacaactgaagttcaagggtaaaggctattgggaaagcagatgaagttaatctaagtaatggatgctgttggtgccccagtcagattcgttcactgggttggtgcacccattcctcagtgactctgagtattagctgctaaagcctcatggtttcacccctttccagagaacctccctcagccaaaaggaagccaccttgactggcatgtcccaccacaccttctctcttaaaaccaccaggggtacaaagggaaaacccctttgcctcatcatggcacctgctgttgtacaatttgtgatctgggaattcccatggggccagattgatgctggtctccagcccataccacatcccaacttaactttcttgccctgtcttcctgcttctctcactccctttttcttaagagcactcagactctgcttctcttaaacctggctgaaggcagtaggtatctgaaagaaaagctgtacctacattctgggcatcagagcagtcagggaaccaaccagaatgaaaagtcaaaaattacagataatgatggaagtctctgagcctgatacatttcatgaagggcttgcttacagctcaacttgtgtttctttttaattgtttcaacagcatttgagtagctcattccgcccaggtatttgagagattccagtaggcctctgatcctctggaaaaagcaagatacagtccttgactctcttggccccatgaggatgatatatctgctgagaaatgcaggagctgcaaaacatagctgggctgtacctgctgccaattcccgggtaattgcattctgtgagggcttccctgaaccacgaggaagagccccggaataagtactaaacaccagtatttataggacatgatttctaattgctcatccttgccttctcatgactagctcagcatgaagaatgctgggacttttctttcctagcacctcctctttttaggctgttttccaagagtcttggttaacaaacatttgtttgacaaggattcatggtagacagcaatgccattagtccctacttaagtaatatttgtaacataaatttctctgcacgtgtatgtagcccaagaataacacttcatttttggaacctagtaattttgaattcctagtaagtgagataggacgtctatgagttagcaggttaagattttaggaggaatatttaatatccctaagaagggaagtttttcaaacactgagtagcactatatatatttatatatatatagccagatttctatctatctatctatctatatatatatatatatatatatatatatatatatcacaccatttataaataaactcataagtggcaaatccagtagagctaatctgagcatcccagagtctcccctctctgtcgcttgtttgtgcagctactcctgctgtggccttttatggattatcctggacttctacaactgacccctctactttctctccatctacaagcttcattttgctttgctttcctcctaatccagtttagattccacagtatattttttcaattacatcctggctaatatcgaaactcccttatccctaaatgtgtgagccacagtcatctgacgaaaccccaaacctggatcaactgttttccccatgcttacatgcaacactgttggagaaaatgagaaagtcaggcagattggttctgctaaaaaatgttgaacctcatcctcaagtgggccctcaacactgtttgccaacctcattacatctcttaggtcaactccctctcacagtctctattacgattaattcaaatgttcccacttacccttaattcatgttttcattcagtgactattcattgcacaccaggcactgcacgctatgccaggcactgcagactatgccaggtctgttgattcctacttcacagaggaaataaaacccctccaagcagaattccctcaatttactctttctagtctttccaactgaccttctgtgctttgcagtaggaatgttctcttaactgtcaagtcaaaattcctccctcaaaaataagattcccttgttaatagacaattcctttattttcttagaaaagtagtagatgactataattttaaatgtgtatttgaacaaatccttagctacataaagataagcaaagatatgacaggcaatttaattttatatgaagaaaaacttattatatcagacttacctatcattctaaatcagtacttttgtatctataatcagacaacatttaatgaactgaaaattctgcctgtgagaaactagtcataataaaattagacttggtttgctctttcatggagaacatattccagatgtttaagtgattcaaagaaaacccacaatataatggctttcttcaatgttttctcacttactgcttccaaactagaaaaaaaacctaatgcaatcctgatatcacttaaatagcacctcgtattgctcagcgttaactgtgctttttgacattttaggtgtagtgtttaataatttaaacacaaatttatgtgtgtcatattaaaagctctaatctgtgaaatatagccaaaccaatgtcacatctatttaaatagcaaagtacctgtgttcaccctttacagggtgaaggtcttgtgactctgtgtttaggcggccatacttcttgttatgtatgctgctgggcactgagagcccacagtggtgagccatccttgggtggtaaaagctgctaccaaaacctaaatcaaatgccaaagtgaagactgacatgagcattctcctgcctccttttcctttttatctttcctaccatctgttatctcctttcttccaccttcatgcgttgagtgccctcatgatgatttctagctgactgaagtcctttagtctgctcaaccccatctagagacttccccaaagtgaacctttgcccccagttatctgtttatcaactgacctcacaccagtcaaagcttccattgtcaaatattttaacagaaatttaggaattcagattaaactgaatatttggcattttttcttttttttttttttttttttttggagacagagtcttgctgggtcacccaggctggagtgagtgcagtggtgccatcttggctcactgcaacctccacctcccaggttcaagcgcttctcatgcctcagccccctgagtagctggtactacaggcatgtgccaccacgcccgaataatttttgtatctttagtagagacagggtttcaccatgttggccagtctggtctcgaactgctgacctcaagtgatccacccatccacccacctcagcctcccaaagtgctgggattacagtcttgagccaccccacctggtctgggttgttttcttcatctttagcagttgtcttgttcacaactacttcaacaatatttattttctttttctttttgaagcaactctccagagtatttggcctggtttttatagaaataataacttttttcttttctttttaaactaatatttttatgatttaggaaatctttctttattaaattacataatcacaacagttactggcaaagataggtttgagaacatacacacaactgacggttgtaacaagtcaactgatgggagcagaaggtccacacatactgacaggcacctcgaacattttattgaggctgtgagaggttcccatcactgctgtttcacaaagagaatgaagactttggctaatttggtgagtcttaagtggagattagttcagagaacttccactatcattgcttgaaagaagcaaaaaaaaaaaaaaaaaaaaaaaaaatcccaagatcttatggtaaagtttaaagaagaaaagtaaattttaaaaagaaaaaaaaagaggaaaagggagagcattgcaattaattatgagtaccaaaacttatttttgaatccccttcatcctccaaaacattgaagcaggattaatatgtgtgctcaggaatttgggagagaaaatgaaaatcaaaatattctaataagagacatttgaaaatgtacattgtgtcacctaaagggaactgaaatctagctatggcttaacgaggtaggataatcaacttaatggcttgagagtcttgcttgtaaagagagatgattagcacaaaggactcacctgtatcactgaaagatgctgcctgctggcttgccctctctgcagaggttcctgtttacagtttcccctcacatgatatttatttgtggctactagaaatgcacgttattatccagaagagaatgatttcattttgtaaccgttgtccttgtccaagtttcccccattgacatttaagaaatctgttttctaacctttctattatgcaaaacaaaattaatatggatcatttccttttagagataagtattcatatatatggatttaaaccacctttctccatgggcccttattctgatacttttaatccatgtatttattcataaggaaatggaacaatatttactatccacccctataaaactttctgaatttcacactgattccagtgacattccactaacacgaagttgaatacagatgaatacatcacatatgattttttttttgcatgtgtatggtcagaaggggctctcttttgtttgtttttattaatatataattcacatactttaaaattcactctttcaaagtgtacaattcagtggtgtttagtatattcacaagattgtgccaccatcaccattgtttaataccagaacattttcgttatcgtccaaaagaaaccccctgattgcttaacgtaatgtttttaatgaccactttttaaaactttaagttcaacagagtgattatcacaatgttttgtattatctaagaactacacaacagtgttatgctctatacagcaccacggtttactgatgaagtattcaggttgatttgagaggataatgtcgttcttattttgaatgttcatactggctccttttatttggagtgggaggaaatgcaaggcttataaatgaggtcagtgtaaccaatggttttatcaacatagtgaaccagacagagaaataacacctgcccagatcaagcaagtcaaaacaacacgtatagtcaagtggtgctgtccttgtacacagacattacattacacaaactgttctcctaagtgagggaatttgtcccttagaaattgcttattggaacatttggacatcatgcatcatgttaaagatccataaatgccatctcgatagggtagatatgaggcgtggtaatatcctccccatatctgcatagggttcttctgctcaacggattgctatgatgtattgcatcagagactcctgctctagtgcttcaaagacagctgagaagccccacgggagccttctgaagtcattgctacaagggctaaaataccaggagatcaggaagtcattctgaggacttgacaaaataccctactccctaaatgaaactgttatgatgtggttggtgcaaagtatgcatgcaatattttatgactgaatatatctttctattgtaaaaaataaggatccatttctggttgtgacatgagtagaatttagaatccagcagcaatatatttttcttgttactttgccaatccagaatttcttaggggaagcatataacataatagttaagaatatatattctagaggcaggcaaacctgcatataggtatcccaggttcctcaatttttacccatgagagcttggcaaggtttgtttgttttgaaaacaaacctctgcaagtttgttttctcatgtataaaattagaattctccaactactggcctcataggattgttgggtagaaataaaatcagtttatgtatgaatagagctcatcatggcattaggcacctaggaagtgctcaacaaatagtagttatcattattcccccattaacaaatatccattgttataatactaccacaagagactgtcttagtctgttccagctgctataatagaaatgccataaattggatagcttgtgaaacaacaaaaacttatttctcactgttctggaggttgagaagtccaagatcaaaataccagcagatttggtgtctggggaaggcccattcctcatacaaagcaccttctcactgcaccctcacatgctgaaaggagctagctagctctctgaggtctcttttataagggcgctaatcccaaaaatcacctccctaaaggccccatctcctaataccattgccttaggtgttttgatttcgtttcctttttattttttaggatttcaacataggaatttgaggggggacacaaacattcaaaccgtagcatagagcaaacattactggcactgcaccctaaagagaataagcccaggtatcagttcttcttgttttaaatattctcatcttccaatttgcttttgactattgcacacaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtaagcacattgtaaacattgttgtcctttgttacagtaaaataatatacagataaaatttgtaaagaacaatgaaagtacttttttcatgtaatgttcatggtaatatttgtgaggataggatattttatattagtttataattcccatctaaacattttcaaattattaatattaattttggaagcaactaagacttagtatatgtcttagtctgtttagtgttgctataaaagaatacttggggctgggtaattcataaagaacaggtgtttatttggctcagttctgcaggctgtacaagaagcatctgcttctggcgagggcgtcaggctgcttccactcatggcagaaggcaaaggggagctggtgtacaaagatcacacggcaagagaggaggagaaaaagagggaggggaggtgccagttctcatgaaaactgctagagcaaaacctcgctcactaccgtgagaatggcaccaaaccattcatgagggattcactcctacaacccagacaccttccactaggcctcaccaccaacacgggggatcagatttcaacacgcgagttagagggaacatccaaactctgtgtagcagtattcttacgataaacagaaaataatgctgaatcatgatggaagatgtgaattgccaccatgcagttcctttgtactcttactgcttggattctcaaaaacatctttccctttagaatcctaatttaaacaagagtcaatagtaagatgtgtccaaaagtcatttaaagaaagagcatcctatcacaaacttacatgtggaagtttttcgtaggtttgcgtaataaatacaggcaatgtaagtgtgctgctcaaggtcacacttactagccatgggacctggagcaaattacttaacctttctgagcctcagtctttcatcaaaaaaaaaaaaatgcgataataaaattctctgcaatatcagtttattattaggatgaataagtcaaaataaatggaaagtgctcgggagcgaacatgccaaatgataaacactctacaaattctagctcttgatgttgttattattattattattacagtacacaggttttggaatccaacatattagctgagtgaccttgaggccacttaatctctgtggttgtccatttactcatctctaacatggttactgtaacatcgaatgagttaattcatgcagagtaatggttgtagtggtggaagaggtgcgtctaccttctcagtgtgaaggacaccatgttataccccaaaaccctaaaattagtttaaccgtagaattagagaatcattttctctcctttccaattttctcctttccaacaggatgcagaaggtatgcctctgaggaaactgggtttaaaactatttggttttaactttttaataagaaaaatataataaaccaaatcactttcctattgtcagtccatttaggggtgtgattgagaggcctgttaaagaattgctagatctttaataaagataagttgcaaatcccagacctcttgagatctcacataatttaattcttgttgtgatggatagtcctgaaagatttgtattctagattgttataagtggcatcgactaaagcaaggcgatatagctaagtgattatatgcctttctctgtttgctccatagtagttgagtactattaaaattttatctgttccatccttagtatgtttttcatcttaagtataaataaggaaagtaataaatgtccaaagaaaaccaatggccacattagtcccatataagtgttctagaagtatattttataatttcttttagagagcagaatgccacgtttgctttcagaacgtggtaaaagatttgtgacagtggcaggtagatttccaaatgaggtcaaaggattatgactagtaagaaaagtttttttttttttaatcaatgctaagtgatccattctagttgcactatttatttgcatttaaggtatcaaaaacagtaaatagcttactatgtagccattctttacaatgagtaaaaacttggttataagtacaggaaaacacatgtaaggagatagtatgatatagcgaaaagagcattggattgactattaggaggtctaacttcaaacttaagctcagccattatttgaccgtgttattgtgagaaagccatttaacctctctcagctttaattctcctcatttttaaaatgcagaaatctattttgtctaaggtcacatacagttcaatcttatgattctgtctctagatatctgggggagatacacatttgacagaatttagtttaaaaccaatgaagttcctttctttattcataatacaaatgtggtttgttgaaattatatttctccttgtataactctaacttttaatctcttcttccctaaacccacatatacacagccttctcctattaaacagttcagtttgtggtgtctgctctatattgtagcaaatttcatgtttctatttttgaacatgaccttaaagatatgcttaaaaagtgtttttagcagaaagctgataaatccaaggttttggtttgcatataaccgagtcaagttagttccattcttttctttgatagtaattctgctacattataaatgtgaggccttgttcagaaagagaagaaagcaagaaatgaggttcacatcaagcaatttttttcccattactggaaaagcaattcatacatcctgttgagaatattttatatttagaacaatgtatgtgaggctaacgcattatccaagttctatggcgggaagcttgagcccaccaccattatgacatcatatttttttaaatagtaaatgtcaaaaaagacatatttctatgaaaataaagaatttagtcacaatgctatgtcaatctttaaatcgtgataaaaaccaagtacaagttcatctttgcctctgtccactaagacaaagaacaatcaaaaagtaaagaactctctgggcatggtggctcacgcctgtaatcccagcactttgggaggccgaggcaggcggatcacttgaggtcaggagtttgacaccagcctgaccagcatggtgaaacctcatctctactaaaaatacaaaacttacctgggtgtggtggtgcgtgcctgtaatcctagctactctggaggctgaggcaggagaattgcttgaaaccaggaggcagaggttgcagtgagctgagatcgtgccactgcactccagcctgggcgacagagccagactcggtctcaaaaataaaataaaataaaataaaaatagagaactggagtagtagaaaggcagatgtaaacctgagaaaagaagaagagtcttaaatttgggcaaaatagtataatagaaagattagagttacatactatcaggccgtgtctacttgatatcagaatatcctgggttctttgcattatccattcatttaattttcaaggaaagccatgctagttttttagctgtctgtaatatcagtcaaaatggtgaaaccagttaagggatgtgagcaccaacaatacagtcaaacccagtcacaatttacctatgtatagaatcataatgtatagagaattccaaactgactttgaatcttctaatagaaatgtaagagacattggtttgcctgtttgaaattttctgtgggaatgaagtcctattttcttcctcaaagtagacacattggtatgcatgttactatttgaccatttgactttttgtggtgtaggaaaccatcactccttgcagttagaaaaagtcctcatgtgcattctctcatctaagaatcacaaccttgtgattttgtattatgattatgattacctattatcattattcccttttacgtgtaaggaaaccgaggcttagaaacatgaagtaccacagtcacagtcacataacttgtatcagtcaagatctgagtcaggtttttcgaactgctattcccatgctctttttgtctcctcttctcaaaatcctattacgtttggacttaacaaagcaataatggctgggtgtggtggctcacgcctgtaatcccagtactttgggagggtgaggcgggtggatcacttgagatcaggagttcaagaccggcctggccaacacatagtgaaaccccatcactactaaaaatacaaaaattagctgggtgtggtggcgcacgcttgtagatcagctacttgggaagctgaggcaggagaatcgcttgaacccgggaggcggatgttgcagtaagctgagatcatgccactgcactccagcctgggcaacagagcaagacaccatttccaaaaaaaaaaaaaaaaagcaatactttaaaactattttggacaatacaggtgtaaaatacttcacttttttacatgtatcttcttttttgaaatgattcttaggtatattaacttttaaatcttccttttataaaccaatggattaatgaacccagttcagtgtaccccttagaaatcacacttgtttcaaatataaaattttaaagcattatattcctcattgcctttagaactcagcaattgtactaaaatcagccaaaagtgatttcagtgaatcagctcttaaagccaaactaatgctaatatttgaccaagtagaaacgaatatctaaaccaggtgagaaaaaagttaaaatgatgataaacctttctaattttgaaatagtacacacactgagtaatgcagtcaatctctttattcaccaagcgcaagtagtatataaaggaatattataccatttttctttactcatgagtaaacccacaaatagcacaaaagctgcaaaaacactttaacataaggagtatttgttttattgactgtaggaactcatggaatgcaaacacctttaaaatctgaataatatgaaggcatttccagctattagattctttacatatgtcaaagaacagtatcataaattatgtatgttttttaaaggtttcctaagcttcttccaaagtcatgtagacatcattacactccatctgtatacctctgtggtaacttgctgtcgcagggatctagagcctcatcttttgcaaacttcattccttctttcatccctttgttctttcattcagtcagcactgattgagcatctactgtgtacctagaagacattgtaatgatcctgtttggtccaaggacatactaaacaaaactccctttactgcttatgctatattaagtaaagctttaaagatgggttctcttttattacttccatgatggcccacccctctcatcctttctcagtgttaaaaaccagaaatatacatacttacatactatcataacactgatactacaaaagcagtacccattattatctctggtttacaaattattcaataatttcttactggaaacttggtctatatagtcatagtagtaagctttgtgagaggatgtgatgggatcatagttagctaaacaataggagtatttgtgtggcttcattttaaaaaaactaaccagtttttttccaacaagcaattcttatatcagaaccatttatattctttactttggtgagataggattttctaagcaggtcttttatctgtatctatgtatgtttgttcttaccatcattgagcacaggatttgatcctttaaatgtgttgacagattttgaacattttcctcatatctttcttttttgttttttaatgatcctgtactaatcattttgcattatggggtcacttctggacagagagcctagccatctgctcttacaaataatgtcggcctatcactaactggggataaggagaagacatctaccgatgtctttctagcatgtccttcttgactttttctttctttaagaagactaaaatgattcagcttgtggttctaccacagaactcaggagaaaatgataaatatgaggccattctccaaataaatatgttttcctacattagtggttctcaaattttaacaagcatcaaattcacctggaaggcttattaaaacacagataactgggctccacataccaagtttcaaatgattcagtgggtctggtgtggagcttgagaatctgcatctctaacaaactttcaagtgaggctaatgctgctgaatcatggaccacactttgataacccctgttctatgttaagtacttgtcaggtacagacaaatttaaaagttaaaaaaatatatatatgacttctgtaagacactgtgaagggtttagactctggggaaattaagtataatgccatcccaaaaactctgtgttggaggagtgttcaagtgctgcaggatcatggagaaccaagcacttaacttttctatgaggcagaaagaggaagataaagggaaacgtggaggatgaagggaaactgttaatagatccccagaaacacaatttgctgctatatggatttatatttactgtatttcaaatcacatggtctagaactgtgctgtccaatatgatagctacatatggccattgagcccttcaatgtagccagtcgaaagtgagatgtgtagtaagcgtaatatatacacatgtaatatgtatatgttatatatatgatatagatgtaatatgtatgttatatatatgatatatatgtaatatgtatatgttatatatatatatatatatcaggatgcaaagacttagtaccaaaaaaagaatgtaaaatatctcattatttttatattgattacatgttgaaatgatagtatttttatgtatttgcttgggtaaaatgtcataatgaatttcactcatttattatgattattcaaacttggttatttttcttgaaaatgaatgaagtgagcctgttgcttcggctacaacaatgggcagtgtttctgcaaaatttttacatgtgcctactagaacatttaaaattgtacatgtagcactcattatatttctgttggatagcattggcctaaaagttttcaaaatctagcatggataagaatcacctgcaaagcttgttaaaccaatccgcccccagaaatttagtatcgggtgaggcctgcaattctgcatttctatcatgctcccaggagatgctgtctatttgtaaccacatatagaaattcattcccaaactacagatgatagagttttacagagaggtgcaaaaatatatttttgcatcaagcattgtctgtagcttgaatacaaaattatgttgcccatataccactggtttttgtaagtaaagcagttgtgttacaaagcatacaagtttttatcagctaatagccttttctcaattagcagatactaagtagtacttttattatgtggcaattctccagtttttggaatgttattgagaaatacacagggttaaaacaaattagaaagcacctctcccaaaatactgcagtaagatgtaggaaaaactgctctaacatattctaaactataggttgctcttatgtaaatatttcaactataatatctagtctgatgtgcccactggccagagttttgtaaaagctaaaagtaaaggaaataaaaaaaagaaagaagtatgtgtttgtttttgaaaaggttaggtcacagaaggatttgttgatattaggaatagaatgacccgtgaaaaaaggacaattaagttccaggaaaacatcttttcagtaaggagagaataatcatttatgcttaacctcaactctgttaggaaaaaaaggatgtaaacaaaaccctttaaagaattgaagaaggagagtataaatttaaatgcccaggttagtgaccacccttagagcatactgaggtcaaagcgtactgtcaagcttaagaacatttggttttcaatgtttgtacaactaattgtactttagtcaagaggactgttatcgaaattgctcaggtagccttgaaactaatatggcccaaatattccagagtctgtctttctcaccctaggagaagaatggtctggttttcaagggaattctctattttttttttttgaaggcatcaggatgtgtgaaactacagggggataaatgaacgatgtacagaatgtgatgaaaaaattatatgaagtataaaatgggaatgaagccatcaggagccaaagaaatatttatgaatttaagagaatgaaaagcatattattattttcagatattttataaagtgaacccaaatcattataaagtattaattaggctacttgattgcttgatctttatatactaatttctaatttgttttaatcgggaactatttttgctagttctaaggctagctattatggtaatccatgtaagtgtgtttattattgtttttaaaaatggaatgtgttcctagtaaatgtgtttaaatagcaaaatgtatttatgcatgcatgtatttattttagtttcctgagacctctagttccttactagaaacatgtatataattccaggcatttaaaattgccatgatggtcatgttttcttgtccttttcccttattctgcaactgacatttgcccttgtctccaatttctcactgctttattctttgttcttgtaagtgttcttgtctctctgggctgacctctctccttccctggagtttgaccccgccccaccctttcttctgcatttgtttgcactggttgttttcttcattgcctttcccactgccccgctgcgctgcatgtgaaacactccgccagtagctgctcacagttcccatgctacatcatacccagcattcaaagagctgctgttctcacatggccgccagtaagattcccgactcctccttcacagcacattcctctagaaagtagaaagaatcccctttcaggccacatgagaagctgcgtgttaaagccaactccataaaggggaatggaaactagcgtatgaaattcagaaatgctacttttaaaggtaaataccacaaagtgaatttcaaattcatacagtttatcataatacttctttatttttataaatgctataatgtccttaatataatgatcactgtgatataagttgtcctctcccttaatatattaattaatttactaaaggagacgggagggtggaaatataataaattagaagatgattcttatatcagaagtacagcctttatacatagttttactttattcagacaatcaatgtagtcatatggtataaatttgaaaataattttagtgagcattacgcttactgagattaatagtgagaacttacctagcacttactgtatgccattcacaattataagcacttttgcatgtgctaatgcttttaagcctcacgtaacccagtgagggaggtacaattttaacctcattttacaggttagaaaaatgaggagcccaagggttaagtgacttgcctgtggtcatatatcaggtaagtgagagagccaggatttgaacccagacagtctgcctggggaatctgtcagaactcctaactatgcagtaccactcctctgataaaaagttgaattgacatgacaacatttcctattcatttatgattcgaccctttaaacaaaaagaacagcatcattctcacatttattaatttgtcaggaatcacctggatcatgagttgaggaaatttaaagtaggagggttgtatgaatttcagaccacgatctcaagaattgcctgtttaactcagagcctgaatcattcacagactaaaaactagaatcactcttctgtaggaccaagagggttgaatcatcaaagtcttgctgaagtgaacggaaatcctcctttgttcaatcattcattcaataattatttttttctggtgtctactctttaccaaactctgtttgagatgatagggattcagtcatagacagaccttctctgccctcatggaggttatggtttcttgggatgacagacagtaattttttaaatctcataaaataattacaaatgtgtcaggaaagaaaatacaggacactaccagaatatatagtaaggacctaaatgtgtgtgtgtgtgtgtgtgtgtgtgtgtgtgtgtgtgtgtgtgtgtgtgtgtgtgcgcgcgcgctgcagtaagggtgagaggcaggaaagggcaatcaggacaccctcccaataaaagtgacctttgaccgagatctgaaggatgaagacaagctgagtgactcttctattcatctatatcttttgttttaaatggcctgaagcctgggactaactaaacagggttgtaaaattccagtatgtaaattgaataactagggatcatttgaagtaatggactgcagagttaatgtataattaagtcacatctagggaagatttcccatcattatcacagagagcatcctgtttgctttcttcacagcacttacgaaaatctatagctatgtgtttggtggcttgtttaatgaaagtctgtttcccctatctgaatgtgagctccataaggacagaggccctgaataccacatctactgacatttggcagtgtctttcatatagtaagcattctataaatgtcttgaatagatgaatgcataaaactaagttaaaatgttactgaaaactataaaaataagcagaaagttataccagaggagaaaaattaggggaaaaaaactataatttctgaagacgtagtacttacatctaaatttgtggcttcataaggttaaccaacacttaaatagttttgccaaaactccaagaaaaaaatgaccgggtgtcgtggctcacgcctgtgatcccagcactttgggaggtcgaggtgggtggatcacctgaggttaggagttcgagaccagcctggccaacatggtgaaaccctatctctactaaaaatacaaaaaaattagccgggcatggtggcagacacctgtaatcccagttactcggaaggctgaggcaggagaaccacttgaacataggaggcggaggttgcagtgagccgagatcatgccactgcactccagcctgggcaacagagcaagactctgtctcaaaaaaaaaaaaaagaaagaaagaaaaaaaagaactaccatttgacccagcacttccattacttggtatgtacccaaagaaatataaatttttctaccaaaaagacgtgcgctcatatgttcattgcagcactattcacaatagcaaagacataaagtcaacctaggtgcccatcaatggtggattggataaagaaaacgtggcatatatgcaccatggaatactacacagctatgaaaaagaaggaaatcatgtcctctgtagcaacatggttggaactggaggtcattatcctaagcgaattaaagcagaaacagaaaaccaaataatgcatgtgctcacttataagcaggagctaacctttgggtacacatggatgtaaagttgggaacaacaggcactagtgacaagggcaggagggtgtgggacaagggctgaaaaaactacctatcgagtactatactcactacctgggtgacaggttcaactgtactccaaacctcagtgtcacacaatatacccatgtaataaacctgcacatgtaccccttgagtctaaaataaaaattgaaatctaaaaatataaaatatcaaatcataaaaataaataagaaaacaattgaatctactgatatgtttcattgcttttaaaatatccactttgaattactgaatattttaatatttttagttttacacttcagcacagaaagtccagaaatccaacccttgagtttacaaagacaccacatgatagttcatagttcacacagctagttagttgtggaactagaacccaaaatttgctctctatgtctctcacataccttttccctttattctaataaaggcatttgtcagtctaaatgtacaatattcgaagacattttttaaaggaactacttatccaaatcccacctgtcttacaaggtccatgtgaagcaatgagataaggtctgtgaaactgcttccgaaactatcaaatgttataaaaatgttaagttttattattagaactgcagttcatctctatgaaacctttctaaactttctcacttttctgaacttgactacgcagcgtcttttctaatctatttgttctccctttataagaagaatttaatcctttccgccctgctgggttgtaagaaaaaggactctcttcttttctataatctattgatatttgattatattacacatctaatgggttcccaataaatacatagtgaatagaattgaaccaaatttctttctagacatgtgaaaaaaaatcctgatctttaaatagaaagggtactttcaaagattatatatagaacctcttggtattttgtatttgcaatgaaaatattttaatttgggccaggtgcggtggctcacacctgtggtcccagcactctgggaggccgaggtgagcagatcatgaggtcaggcgttcgagaccagcctgaccaacatggtaaaaccccgtctcaatcaaaaatacaaaaattagccaggcatggtgacgcatgcctgtaatcccaactactcaggaggctgaggcaggagaatcacttgaacccgggaggtggaggttgcagtgagctgagatcatgccactgcactccagcctgggtagagagggagactccatctaaaaaagaaagaaagagagagagagaaagaaaagaaaagaaagaaaatattttaatttgtcttatgttcaacagttgcatcatatctgcatccttttgttaaaattgaacaggcttctagtttcatataataatttctggccaggcgcagtggctcacgcctgtaatcccagcactttgggaggccgaggcgggtggatcacctgaggtccggagttcgagaccagcctgaccaacatggagaaaccccatctctactaaaaatacaaaattagctgggcgtggtggcacatgcctgtaatctcagctactcgggaggctgaggcaggagaatggcttgaacccaggaggcggaggttgctgtgagccaagatcacgccattgcactccagccggggcaacaagagcgaaactccgtctcaaaataataataatcataatcatcatcatcataataataatttctaccaacagctggcaggaaaaaaatatgagagcatagtcatgaacttcagattccactccccttacttttggcattccattcctctgaattatagcttatatttctttattatctcagtttgatttagtctttctaaatattcacctctgtttccatccataaatatcgactgaactaccttttaatatactatctttttgtaacagagaaaatcaagtgtaggtggattattgtaagtgacactgaggaaatataaaaagaccttgacttgtccaggcgcggtggctcacgcctgtaatcccaccactttgggaggccgaggcgggtgaattacgagatcaggagatcaagaccatcctgaccaaatggtgaaatcctgtctctactgaaatacaaaacattagccgggcatggtggcaggcgcctgtagtcccagctacttgggaggctgaggctggagaatggcatgaacctgggaggcggagcttgcagtgagctgagatcatgccactgcactccagactggtgacagagtgagactccctctcaaaaaaaaaaaaaaaaaaaaaaaaaaaagaccttaacttgcttcaaacaagtcaggacccccaattccaattcttaggtctggcattcccatcagacacttaaactgtaggggcagtaaagttgcccatgtggctacagcttttgtggctgtgctgtacttgggaattttaatgttaccctctttgaattaggtccttcattgatcatgcatctcaaagtatctcagtgccacataaaaattttctttcagagtcatattttcccattatgaatgctacctactgcttatctgttgagtgtacacttttaaaccttctgtgggtggtggcccctttgccactgggtgagttagatgctgatcctggtcattatcgctgcctttccagccttttctgctcttacaccaagcacaagaattctctgctgatagtcaggatctagggctgggaaaatgggatgagttgtcctgttagacaggcccaaaaggagtattgtttaatccccagggtgtggggaagaaagatactcttgttttcttttccccaaatgtgtccatatacacccttctcctttgctggcagccaccaggcttgttgaggatctaccctcctctgcatatcatgtgcatcaagggaagccccaacccaagggaatacataatgatagtcctgagctatttcatggtgctctcgcagtcttgattgccctcttcggaattggacatggtcatattacgcaattttaggtaataaaatacaaagggcattcagctaagggaccttctgagaaaggtttttctcgtctagagaactaaacaggcatccttctccgggcactatgcgtagttctttattctacctggaacattctttctccagaaatctttgtgactaactctgtcatttccttcaagtcttattcaaatctcaacttaaaaaaaaaaaaaaccttcttaaaatttgaccacactaattagacagcaactgccccatctccctcttcccagccatctgaatccatttcccacttacctttttatgatagctcttctaggaaggcactccctcctccctgtgaatcatgtctccaggcaattgttccttgtgtagaggaacacaccaaatctgggctgctcctgtacaacaaactgaaggaggtagaattgattctgcaagaagttcaaagctaaataagaaggagtcttgtagcttctgtcttggtcttctggaatgctcactctggggaaagtgatctgccctgtactaagtctactctaaggccactgtgctgtctacatgaagaagccacaaatctaagctagccacatggggaagctgcatggaaagacaaatacgtggctagcccccagctgttggccgaagatccgcagccatcccaagtgaggagccagatgtacaagtgaaaaaactgtaacagccattccaatggagccttcagatcaattcagctttggctactatctgactgcaaacacatgaaagaacccaagcaagaaacacccacctgagcacagtcaactcacagaaccatgagcaatactgataaatggttatttttagccagtaagttctagggtgatatatagcaaaaggaacatctgtcctgttttttctggtttttcctatcatacactcattctgcaggattaacatgtgtaatatactttttttttttttttgagatggagtctcaatctgtcgcccaggctggagtgcagtggcatgatctcagctcactgcaacctccgcctgctgggttcaagtaattctcctgcctcagcctcccgagtagctgggactacaggcatccaccaccacgcccagctagtttttttttatttttagtagagacggggtttcaccatgctggccaggctggtctcgaactcctgacctcgtgatctgcccgccttggcctcccaagtgctgggattacaggcatgagccaccactcccggcctaatatacttttttaaattgtctttcactatgagaaggtgagctccatgaggccagggatattgtctgttttgttagctaatgtatccaaattacctaagaatagatcttagcgtggtaaatatttgttgaatgaacgagtgaatagatcagaatttcagtagctacgttgtgagtatgtggacagttcaccaagaatggcagaatggaaggatgggaggaacctggaataatgtcattgtgcttctggattacccagtcctggagcagctttgcctctgtgggccttgactagtcaagacattttgtgttgggtttttatgttaattccatttgcatcactataaaggaatacctgaggctgggtaatttataaggaaaagagatttcattggctcatggttctgcaggctgtacaggaagtgtggtgacagcctctgcttctggtgagggcttcagcaagcttacaatcatggtggaaggtgaaaggagaaccagcgtgtcacatggtgagagatggagtgagggggtgggaggtgccacactcttttaaacagtcagatcccacatgaactcactctgagtgagaactcacttattactgcaagaatggcactgagccattcgtgagggatccagccccatgatccagtctcccccaccgggccccacatccaacactggggattacatttcagcatgagatttgaagggaacaaacatccaacccatatcagttttctacaacctgcagcagaaagcatctcatctggcacatggtcttgcaaataattctgacttagatgcatgggactcagatatgactgaaccagaagataaatctaagtagcagacaccacagtattctcaaaaccactctttctctttctcttgttgaccgaggcttttctactgagcaaagcacctggtttataatatgttctttcattacgccttctcctaagagacctccttagtgtccctgcaatggatgtctggggagccaccaatctcttagagatgactagacatgtagccccagaaatggttacaccttgagcttttctctcagtgcagatgagatacattgcccatcccaccaatttgccacatttatctaaatttctgtgttaagctgggacctctaccactcaagctgggatgcccctcaccaccaccacactgcaaaaactaaacatttttcattagcctcctacttgcaattaagtacataaaacctgcaaaacaagtaataaaattaaggcactatttggttaatgccttttctcagaaatcacttttgcatgaagttcagttcagtattttatcagtgactacattagtctcgagaccctctacccaataggagggacaaagatgtacatgacacaggctcccttcaaagatgattaatacatgaactacatacagtattacaagggctccactagagatgtgagccccccagaaatgatattaatgtgcagaagagttagcaataaattttgcacaaggggtgacatttgagcttagactcgagcaatgagtagggttccaagaggtaaagaaaaaaatggaatggttttctaggaagaaaaccaggtctgggaagatctgatataacctgaggtagtttataagtctggaatgactgagttatcgggtatatggtggggaaggcagcagaggtgaaataagtaatatctaagcaaatgaaaaacatgtaattaggggagatgaaatataattaaattatttaccttaattcctcttttgactctttacatttgtcattcataaggaaacaatttcactaagattgttttgacctttttaccttatttggccaagtaaacaagggacagaaagtttttaatgtaaaatattcattcaacctgaaagaacattgatgattccagaccatttaaagttaaatattttagagttctcaattatttctatttggatgagtagaaccttttttcagacttcaggaatatatgtttagtttttaacagactaattgttcctgctttcatgccagcctcatgggcatcagcaggttcaaggttagtaggtaggaatctgccccctaagaatgcagcctaagagttaaggaatgcatgattacccctgtaattacttgagaggggctctgaaattctggcagggttggtgaggccaccagataacactgatcaagaatgtacacgaggttaggaattcagactgtagctgaagtggggagttcgggtaaacaggctctgaatggaaaagatcaggaattcaaatagacagttaagtcaagaaaccaacatcttagaaatgtaaacctcactttaagtcaaaggctctccaagctaagacttcataatatatttgccaaggcaagagctagtatctgcttacctgagtggtcctggagctgcggccagttgaaacaggagattgcagatggaatgtcagttagaatactttcagaggccagtaacagatacctgactttaaagttcttaagtttgtctttcccaaggttttctggtcataagaatcaccaggggcacttgattaaattattaattcacaagccccttcactggagattctgatgcaatagacttgggaatatatttttttttaacacgaactccagtggaatcaggcaagaagtgaaaaccctatcgttaataatagacacattagaaataatagagacatttgataatctagcacagttcccaaactttagtatgcatcagaatcccctgggggcttgttaaactacaggctggcaggctgctcccagcgtttctgatgcagtaggtccagcgtggagtccgagattctacatttctagtaggttgccaagttatgctgctactcctgtggtcaggaactgcactttgagaaccactaatcaaaataaactgaagtccaaagaccatcagacctagagctggttaattcaacagattagctatatcaagacttgaggtcagcttctctgggattctcttgtctttttcctcatggtcccaagatggcttcccactgcgccaagcaacatatccgcagacaacaataaccaaggcaagaaggaataaggttcaaggataactgtattgtgtgcgtgtgtgtgtgtgtgtactcatgcctgtgtgtctgtgtttggaaaagcaaacgtttcccagaagctccccaacaaatttcttcttatgtgtcaactagaactggatctcactgaacctctttaagccaatcactggctatgagaaacaagcttactgtgattggcttagaccagattttaattttttcctcagagctgtgtcctttgttgcccaatatctgaacataattgagcttctttaccaaggaacaagaagtaaatagctgttagttaggcaaatagctgggtatgtccacaaatgggttctgaaacaagtgtgattataatgaggttcagaattgaaaatattagtacaaatgctagtaaataatgtatgatattggctttcttatcaccatttgcaacagaataacagtctcatgaagaatttggcacagccattgtagaaaaagtgccttttcagagctcacagtatgcatgtactcatcttgcttttattatacctgtatatggaattgcaagctgtcccttcaggtaatgaaatttagacaagttggaacctgtataacagcaaatcaatactgaaattataggcaaagcctgtacttgtgcagactaacacataggatagaaagactttgtgatcaaaattcaacaaatcccacatttataggtatccaacatagagagaaaactatatatagtggtgtgtctttttatgtgtttgcgtttttctccttattcattcctgaaagtgtattttcttttaacagactcacaactcagctacaccccatatgcccacagtcaacacagtggaaaactgagttgtttatttgagcctcaagtcatccaaatacttcgttaaacgttgtagtaaaaggtctcccctgaattcaaggaggatgccctaagttttctgcatccttttgatagaggaaagtattaactaatgtcagactatctgttgttttattttcctttacagcactagattttgttaaggacattgataattttgaaagagaagctaagctaaggtgacaaatatatcttctgttggtcaatatctaaaattatgtattatttcttttttgactacaccttacagtggttagtttgcactttacgtaaaaaactgatgtctaccatcttccatctttgtaagcaccatccagcctaatagttgttggtttgaataatgccacaagctttgtccagaaaccaaaaacctgatttccaaagactagtctatgtagctgagcccttcattccataatcattaaactatggttaggacacagtatccagtctcccctcaaccttgtccaatcacagtctatgcagagatcatgtaactcgattaaaatctagaaccatagagacatttcccttccctggggcaaatgggaattgcacatgggggaaaatggtgtggataagcaaaaaacggaagtttccaaagtgcaacagaatattgataattttagtacatttcaacatacagtgagtgtaatgacggcattttcctactgcttccttagttgtgaagattttgttttttcttctgggttcactgccgggaaaagagcagaaaatgttttagagcctctgccagcagagggggcatttaccatttgtgcataaggtctctggcactgtgccctggggttctcttttctatatgtttctaacagtcacacacagcagtgtgactgtttacagatactttaccgtcttctctgattgaagcagggactggtttgccagcaacttttggttgtttttgtttttttgaagaccatgcaactaacagatgtttgttgttggctccatatctacattctttgaaagctggagaatcaaattgctgacattcagacaacactaattcccatatccagggagcctaatttgccgtccctgagatcctgattcctggtgttcacgggtttaaaaaccatttcagtgacacaatataagaatgggcttgggagatgcagcgctgtctccactaaagataatcacattttataaacatctgcgtcattactggtatgattcatctctaagctgtatacagctgtgtttccagtttcaattaacaatcccttaattgcatatccatctcatgttactaatttagttaatttattcataattaagagtattctgttttctaccaaggtttgtcgagctcagaacattataaagaaaaatattttaaggcagcatctccgagggattttgtttcttataatcacatcacagtaaaatgtcattcatgcgcccaaaggaagatgaattgctaagggatttttttttccagtaaaataagaagctttgggaagctgcagtgtgttgtgtttttaaaccaagttaaatgcgatgcattttgttcttttctttctccttccctgacatcctctcaaaaaaattatcattttatttgtattattgcttaagtatcacagcaaatccagtcaccagtgcaaataaaactgtcattaccctgtcaggtaatggtgtctcttaaaatctaagctataaagtctgtacattttagaggacattaagatcaagaatttttaaattgcctaagtctaagcaagtggagtacacccttgtggaaaatggaaggcagatgaaaacatgatgccaggcagtgaattcattttagtttgatcttttctacaaaaatacatatatccgtgcagcaagagtcttgcctgtgttagtacatgtgtctgtgtgtcattcaaagcagcaataacaaaaaattaagaccatttctcactttgtttattgttcaagaactcccacctatagccttgacctgtgtttgagcttaaaaaaaaaaaaagtcttataactgcccagtggtttggagattttacacaatagaaataataagccatcttttgcctcacatgaattctactaaaatcaaaactccataggatactttccaaagtaactggtgaaaggaaaagtgtggtagtataggtatgcatattatccccatcactttatttctgagctcttctattttttaaaaattttaatttgtatcttaaaagggcaaaacataagaagaggtaggagtattctaaatttcagtgacaacaaattcatttattttacaatttaaccattgcccgtcaacatttacttaaaatttcagcatgggaggttttaaacacttctagagtcccatcttaccccatttccacgatgcttttcttctccatgtgttgctgcagtttaatattgtctgcgtgttttaatatgttaaacgagttaaacatagagtaggaagttaaaactgttagcagctatatgtttcccaagattgatgaaaattcaggtaacactccaacctgttaaagatacctgcaatctggccaggtgcggtggcccatgcctataatcccagcactttgagaggccaaggcaggcagatcacctgaggccaggagttcgagaccagcttggccaacatggtgaaaccccgtctctactaaaaatacaaaaaacatttagccgggtgtggtggcatgcacccatagtcccagctactcgggaggctgaggtgggagaattgcttgaacccggagcctgggtgacagagtaagactctgtctcaaaaagaaaaagaaaaaaaaaaatatatatatatatatgtgtgtgtgtttatatatatatatatgtgtgtgtatatatacatatatatatgtgtatatatatatgtgtatatatatatatatatgtgtgtgtgtatatatatatatatatatgtgtgtgtgtgtgtatatatatatatagaaagagagagagagagagagagagagagtaagcagggaggggttgaagccagaaaagactagaaattatctaggccaaaccctttaatttatagattaggaaatagtttctggttgacttagctgagacgttctcatttgttaaaagcaagatcagaaatcagacacaattcaacgctcttcactacaccttgtttttctctttgtggaaaacaagacgtatcctgttcaaaaatttatgctgtttatctgaaagcccaaaatgcctgtttacatcatattttccattttgcaatagcagctcattttggggattattttctgatgaaatctctaggtttagttgtacttgaatatctttttatctgtacacactggaatatgcatataataattgatagaaatgtggattttaaaagtagagatgatcattattattttatgatcctttaagttaataaaattcacctagaataaaataaacaagtttaactaaagttctcgcattttcccagaaatcgtagactagaaactagtcttatttgcttattttattccaaagcttattttacctctattattttgtggttctataaaatatttctgtgtattcctccaaagaacctcttggaaaagaaagtaaacatcacatctgaaaaatagctgggcattttttcattatctctgcaaggggaggggacgtgaaaggcaaccccatatagaaactcaactccctgctttttacaatgaatgaagtttttccactgcactgtcagaatggtaattcttgctaactactcacctatttcacaacattaacagagttccaggattcatgctttaatattgcataatggtccatgttttgaacatgaggagtggcagcggagattacactttgattccttggatttcatgtggcactggatgggagcaaggcactgattttaagttgagataaaaaggagaagtcagtcaatgcctgcagccagacaggactcttgtaatagctagggagtatgcctcatttggatatgcatgactgccgggcaaggacactgccatgaatcgctaatggcagcagttgtatgacataagagagatgtgtatcagcaactcacaagttgactttgttacatgttatgaacacattcctgtgggcactcattcatagaagtgagaaatgtggacaccacagtgtcccaggcctttgttaccttatggcctgggaatatcttgctttgctggaacatgaagccacgtctggttataagaagaagtttgatctgggagcaaaattgcctgttcacgcatgtctttctcacttctttaaaactaacttgctataagggtgattaaaaaaaacagatgtcaggtgagagttttgctttgcatcaacttcctacttgtagaggtaataacataaaccttgcctggcaatcattatttgtcatccagctgagggtgtttactcttgagaaagaagtaatggacaaaattgacttggattctggttctatgtttcccattaattgactctggacatatacatgcaatttaatccatcttactaaaaacatgaccaactcacaggatgtaaattctattctatagaaagggctttccctcagtagttagtcaagggacggttcctaactcctgtctttattgagcttattttccaaaataaatgtattattttctactttgttcacagagcaaggcagcataaagaaattaagcaacaaaacaatagtgtatttttacccaactttctagaaaacacccatttttcttaagttttgatatttttttgccaacaggcagtcaaaaagaagataaataaaactgggttaagttggtaatgacacaataaataaatgagatgaagaaagaggcaataaatatgagtggataccaacaagaaacatgttcaagccctgaaaaaataatgagaaaaggtagaactattaataatacatcccgctctcgtatcacaccttgctccccagatacatcctatctgtcctggcaccatgttgatgctgttgttctgtaagctatgccaatgaacatgttggatgacctactccagctctacctcaagatttccaaataagaaaaggacccagggatctccttgctgaggtctttatccatttactcaggtcacaagtactaattaagcagctcttatgtgcaaaatgttattgcttcaggtcagtttttcctatactgctgttctataagagaggaagaaggtccctgccctcagaaagccctagaatacagatctagagatgggttcaacatctttgttatgcaattatttcattccaattgtaatgagtacttagaaaggacaaaagcagagtgctgagagagtataacagagggacttgacctggtgtagtaggcctggaaagtttcctggggaagtggtattttagacaaacaacacacacatacacccatgaatgtatacgtgtggagaatgtattctaagtaactatgatgaatgtatttcttactgtaggtcatggtcaaagtttgaaaactattgttctaactagtattataattccagggatagtagaggtcatgtgacctgtttagcacatgcctgccttaacagtatctagtaggccaggcaatgtggctcacacctgtaatcccagcactttgggaggccaaggcaggtggatcacttgaggccaggagtctgagaccagcctggccaccacggtgaaaccgtgtctctgctaaaaatacaaaaattagccaggtgtggtggtggtgcctgtagtcccatctactggggaggctgaggcaggagaattgcttgaacccgggaggcggaagttgccgtgagctgagatcatgccactgcactccggcctgggccacagagtgagactctctggaaaaaaacaaaaaacaaaaaaaaagaatgtctagtaaataagtcagtgccaagcaactacctgataactgttaccaccttagtcatcaccgaaggcagaaggtcttgcattcattggaggagagttaccaatctaagacatttgcatgaaaatgtgcacagagccctcacctgataatcaaagcatgttccaacacttctctttggataaaataagagttacatctcaatgaaatcacttgtggatcaagttctcatcctttcgtaaataaagagaggggcagcaagaaatggaagtgagcacatataagtgtgggaacctgtactttcctaacctataaagcattggatgtagtttttgctattggtgcgcatggagtcatgtggccttggagcagttaggtaccttccctgatgataggggagaaggcaaagaaattgatgatacatctctctcattgtcattccctagtatattacacttaaatctaactgccctattttgtgattgccttactgctgtggcttgaatatttgtgtctccccaaaattcatatgtggaaacctaattccatatatgatggtattaggaggtaggccccttgggaggtgattagatcatgagggcagagcccacatgaatgagattagaacccttataaaagagacccagagagctgctttgccctttttgccatgagaacacaagaaggtgctatctatgaacaagaaagcaggccttcaccaaacactgaatctgccagcgccttgatatcagacttcctagccttcagaattgtgagaaaaaaactttggttgtctataagccacccagtttatgatattttgttatagcattccaacggactaaaacattcattttccagaaaatctactccatttataagccagcattcttttttttttttttttaattttctacagatctctgcagaaacatgcagagtaataatagggccaggcacggtggctcacgcctgtaatcccagcactttgggaggccacagtgggtggatcacctgaggtcaggagttcgagaccagcctggccaacatggtggaaccccgtctctactaaaaatacaaaaaattagccgggcatggtggtgggtacctataatcctagctactcaggaggctgaggcaggagaatcacttgaactcaggaggcagaggttgcagtgagccaagatcccaccattgcactctagcctggacaagaatagtgaaactgtctccaaaaaaaaaaaaaagaagtgataatatatttgctgtatatattagttatagatagttatattgcagtactatcagaagctatgccacatattatttacgtatttcttaagatatagaaaacatccctcccctgcagtcattagtacttttgcattcaaacttcaaatgaaacaggactttagaaattataggcttggtgccatcctggccaacatggtgaaactcgtctctactaaaaatacaaaaattagctgggcgtggtggtgcacacccgtagtcccagctactcgggaggctgaggcaggagaatcacttgaacctgggaggaggaggttgcagtgagccgagatcgcgccactgcactccagcctggcgacagagcgagactccgtctcaaaaaaaaaagaaaaaaaagaaaaaaagaaaagaaaaaagaaattataggcttggtgatttctcaggcattaactcaagaaagcagcctttataccgattacctacattcacccagcacttaccccattaatttctaatgttgcttggaacaaatgaacattcctggaatgcaagctaaatgaaagagccccgaagaagaacagggcatttcctggttcctcatattgacaaatttaaaagcctgtgctataatatgggctcctgtttcctttcaagtttgtctttgaataagtggacagagtagctgaaagcagagtatttaaagctttgaaacgaccactttatttcagtctctgttcttgctgggaccactcttataaatgaggagattagaaaatcacctagaactatttaatcgttgtgcagaagaccctcttaccccaaatatttacttaccgctcattttattggcacactgcctcaaattccacctgctgtgaactgacctaagtgaatttaggtcacgtgcaactattaggttctttttgggaaataatggagaaccacagatgtgtttgaggtggatgaggaatggctacctcaagccgcagcttcatgcttcatgctgaagtcctccacaagtgcaatcatgtcgttaaccaacatttgttagaaggcaggcagaagtcagcttacagcctgttctacaatttttatgaagtgtaggattttaggcttaaattgacaccattgcaaatacagtattctcttacctttagatttggcatcaggtcacaagaattcttcctaagccaatggttggatacaaggccattggagaccagacgtaaaattaaaagcccaagcaacaggttttgctggattcttatatcctgtttatgcaatgttaggggatgtcattaaaatattttagttaatccatgtatcttgattgtcttaaattttactaatgagatcctatagggatattcattgcaatccactatttccctcagcaaaaacacatttgcgatatctattacatgcattacaaaatcctccaaggttcacagagatatatagtagtagcagtctctgggttttggcctttttcataagatgaaggctgtgctgtcctagaatatgaattcctaattaaaataaccatttgcctcaagcctctagagttgaaggttgcactaactgcacatataaaatatccaactatctatgttgagatatttaaaattaattacagatattgtaacaccattatttaacttaaattccattacaggtcctttgagtatgcaaaatatttctttgagatgtggtaacccctttaactgatcaggaaataaacctttattatcaagttgttatcccaccttgacaggcctaaagcgcagaccacatatcagaatcccctgggcagcttataaagctcctcatgcccaggctgcatctcagaccaattcaatctctgggggtgggctccaagcatcagcatttgttgaaaatccccaggattacaaagtgcggtgaagtttgcaaacccttgtaataagagaatgggaggagggatggctgtttgccaagcagaaccaggaatgaggaaggatattggtaaacaaaatttatccataattgacttttcatgaatcacagtcctactgagacccagccttgtctcatgagactttggctacgatgatgagtgagaaaaggactcctcctaatttaccagactcttgattagaagcaaatgaaattttggaaaagagacaagtcactttcaaaagaccccagcctgtacctgaccctacctctggactccatagtaatggcaggtagtggtcattcctggagtaactctgtatttcttaaaggaacatttgcataatgaacctacagcaatctggaagacgactggggtaaatagagaatttgttgattttagatggctgaatactatccgtgcagagcaattaaaaggacaactgtcagaatcaagtaagagaaaggaaataagagaagtctcatgttagtagaccttgtttgatcaatgtgttttcatcttgtatatgattaataaaataagtttgggagttaggatcaacctttgtttactcactggagaataacttgcatatagaatgaagctgggattgtccaggctggtttttttccatttggaagtttggatacaatacaaggaagcctgaattccaaactgtttctcttaaagagtgcctttctgagccgctattaaggaatgcttattgtttcgaaaatggtagcacagaagtgttataactagagtacaccttgtgcctgcaattaattacccagtgtcttcaaaaattcttgtcttttgctggtagaaaacctttgaaactatagttgtctgtggtattcactgcagcaccttagatataaagagagaaatttattttcagaggaatcttgagacagtttgtgtgtgtgtgtgcatgcctgcttacacatctattggttttccccaaggattgtagaaatcccattaaaattccagcttcttaaggagctactgaaactccagtttttcatattttcttttataatatttggatgcgtttaggtaaacttgcagcattttaattatgtctgtatcagatgagcggaagaaatgtaaaagggtttggggagagatttaattttagatagcggcgtaattaatagcatttggaaaaactagtggaactttaattaaatgtctctacattaatttagtcatttaattgaacatgtagtgggatagtccttacaatttttcacccttactctttgaggaaaaatgatttttgaataacaaagcatcagtatgactactttttattatttagctgtatgttcactacttggcactttgtttaatttttccccccatatgtttcgagctttttaaaacattaatttggcttgtcgcttttatcttaaaaactataaatctgggggccgggtgcagtggctcatgcctgtaatcccagcactttgggaggccgaggtgggtagatcatttgatgtcaggagttcaagaccagcctgaccaacatgacgaaaccctgtctctactgaatacaaaaaaaactagccgggtgtggtggtgcatgcctgtaatcccagctacttgggaggctgaggcaggagaattgctggaacccagggggctaaggttgcagtgagcagatattgcaccactgcactccagcctgggcaacagagtgaaactccatctcaaaaaataataataaaataaagaaataaagaaaactataaatctgggagaaaccgtatttggaaacattgagcaactgtttcttttcctttattttagactttaatattcactagagtcatgttgtaaagttttcaccttaatattgtaggctttttttttttttttactttgccaacttaactggcttttttaaagtggtgttatgctgcagcagtgtatctgaatttcagcagtgccttttacgtggctgctcacaatcttattaaactacatgaattatacatggagagaaatataatttggtaaatttggtgatgtttcaataaccatgcccaaggaggaatgttgtgttaaactgtcaatttgagaagtgttttgtggtgctaaccacagagtgaattcagttctacttcatttcacaaccctccataaatagtgccccctaaaagtggtgcctccttgcctgtactttgacccagatttttgtcatttttctagataagcatatacattgtgcacttattaatttttcaaatgacacaaaggtgagaatgggagtcaacacactgaaagatcaaaatcaagactcaaaataagattataacagactgggatactgtaccaaaataaaaaaattaaaataaaatttaacaagaacaagcaagatgtcctgcctttaagatttttaaagtcttttgtacaaatataggctgaggaacatctgactttgtggcgctttatatgaaaaacaaattgggattttaaataaccacaaggactgtattaatctccagtatgatctggtgtggcttactgtacgaggcaatacagtattagattgcattaatgaaattcacaaatgttccattaatctcttcactagttaaaccacatctgcagtcatattgacttatgagcatcacgtatgatgagaacactgaaaaatcataatacattgacagcagggcaaccaagattgtgaaaggtatagcgatggttatatgacaaatatttgaaagaatctagaatgttcagtaagaagataacatgaaaatacaggacagcttcttcatgcatctggggagggtgggtaaaggacacagcacacttaattaagtaagattgtagaagagaactatgggcaagtgttacagtggagcttactctgagtaaggaaaatgtaaacgttagagttgttattaagtggcatgggctgcttcacaaatttccatcattttttaatctgattcatctgctaataggacaaactgtaacaatagcttaaacaatagagaaatgtaggtctctctcatgtacaagcccagaactaggtagatcaggcctccttccgctattctgcttcactaagtccgaagtcctcctttaccttgtcctgccatggtggcctcaattctcgttgtcaccacatggtccaatatgtctgcttcagctccagccaacacatctgagttccagcccccagcaacatggaagaaggaaggaggcacagagagggcgtgtgccagcagtgttgtgagaaaatctttcagaaactgtcatgaaatgtatcccctgatagttccttcaccagaactttgtcccatgattatatttacatctatgtgaggctaagaaatatattctttccttcaggcatctacatacccaactgaaaattatgagttctattgccacaagaaaaaatggaaaatatatggggacaatcaacagtacttgcacaaagatgttttacagagaattactcttttacctgggaattttacaagataaactttaagatcctatcaactctctctctctctttttttttttttttttttttgagacaagagtctcgctctgtcacccaggctggaatgtagtggtgcgatctcggctcactgtaacctccacctcccgggttcaagtgattcttctgcctcagcctcccgagtagctgggactgcaggcgcccgccaccatgcctggctaatttttgtatttttagtagagacggggtttcaccgtgttggccaggctggtctcgaactcctgacctcaggtgactcgcccgcctcgacctccctaagtgctgggattgggattacaggcatgagccaccacgcccagccagatcatctctggaggcagggggatcacttgaggtcaggagtttgaggccagtccggccaacatgacgaaaccctgtctctactaaaagtacaaaaattagctgggtgtggtggcaggcaactgtagtcccagctactcgggaggctgaggcaggagaatagcttgaacccaggaggccaaggttacagtgagccgagatcgtgccactgcactccagcctgggtgacagtgagactctaactcaaaaaacaaacaaaaagagtctatgatcctataatttatagacaacatacaacctcctttctctacaaagagaattggttctcaagggctgtttggaaattcatttccttttaagtccaaaatgacatacaaaagtgaccaatatatacaatgtacacccttctacaataagttctcttttgttgccgtagtaatcgcatgtcttttcttaaaggaacacttttttgactcttttgtacttttgaacatagcggtgttaataataatatttataaaacattatgaaaatatgcacacaaaacacaacacaggctaagaaaacctaatggtggcctaaagtaagttctgatgtcctctgttggtggtattcttcattgccatgcttctgctgtgcctgggacctttattgctacctatgggaagttgtaagtagagaagtttctttactacagggatgtgaacaatcattgtaagtaaggaataatgaattcacataagttcacagagcatgtttttctgccctggtaatactgcatttctcactttgcatttaaagtacctacgcccttacacagaaaaagttatcggggttgggtgcagtggctcacgcctgtaatcccaacactttgggaggccgaagcagggggatcacttgaggtcaggagttcgagaccagcctgggcaacatggtgacaccctgtctctactgaaaaaaaaaaaaaaaaaaaaaaacacacacacagaaaaattagccaggtatggcggtacatgcctgtagtcccagctacttgggaggctgatgtggaagaatcgcttgaacctgagaggtggaggttgcagtgagccgagatcgcaccacttcactccagcctgagtgacagagtgagattccatctcataaatatataaatatatatatataattatcgattgattaatattattatatggtccccattactctaaactctcaaaatgtaatgtaggtcaaaatcagaaaaaggccatactgtctactccttcctctgtttcattccaactataagagaaagggagagggcaaaacaaagatgacaggaggccaaattgtacatagaattcatggaaattcttacccaacatgtaaaattatgatagtataaggaaaagtatactgcaaaaattaaacttctacattgtgaaatggagaacatttttacatctagctctattgcttctccctgtggagctgttctaagcacaaagttcccattacataatgaacaactccttaaatactgtgcaactatttctcactagaagcacgatgcagcaaactctgtttctcagtaaccatttatatcatacctagtggtaccgagttctataataaaagggtgatatgtgcatattttgtggtcatagagtgcaaagttgacatctacagtttaaagcattgcattgcatgaataaggtcaaaatttaaatacttttctatgatcatgttctttacattaaaggttaaagatgcatgccgctttaaaaatggtttaagggccggacacggtgactcacgtctataatcctggcactttgggaggctgaggtgggcagatcacccgaggtcagacgttcaagaccagcctggccaacatggcaaaaccctgtctctactaaaaaatacaaaaattagtcaggcatggtggcgggcgcctgtaatcccagctactcgggaggctgaggcaggacaatctctggaacccggaaggcagaggttgcagtgagcagagatcgtgtcactgccctccagcctgggcgatagagcaagactctatctatctcaaaaaaataaatgaataaaataaaataaaaatggtttaagaacttcaaaccatctggcaccagaaaacacctaaattgaattaaaaatctggaaatttaatttcacaacttgtcctttttcaagcctaccctaagttttgtttacttaatggggagaatctgttttatttgttcctatgtagaagactgctgattttatcatgattgtattagggcccaaggatatttaaaatatttcagtagctattacttatactttatatctgcattgcactttagagttgactgagcattttcaaagtattatcttaccaaattgccacaatagtcttgagaggctagtaaatcatgggagaagcccccatttccccactggaaagcagagaaaacccccattgtagtaaaggaggggttccctccagagctcttgtggttgtgttgaggaggaagtattaatgctgctgggcatgacttacaagaaataagtcaattcacttaagcaaaagtgctatgatcctgtataccatgtgagcagctctaggatggggtcacccagcattttggagcagacattagaacatctggagggagtaaacgcaaagaaaatgggctagatacctttccttggatgggaaaggataacattaagataccaagatcaaatgttcaaagagcacatatacaccagagaatactatgcagccataaaaaatgatgaattcatgtcctttgtagggacatggatgaagctggaaaccatcattctcagcaaactatcacaaggaccaaaaaccaaacaccccatgttctcactcataggtgggaattgaacaatgagaacacatggacaaaggaaggggaacatcacacaccggggaatgttttggggttgggggagtggggagggatagcattaggagatatacgtaacgctaaatgatgagttaatgggtgcagcacaccagcatggcacatgtatacatatgtaacaaacctgcacgttgtgcacatgtaccctaaaactttaagtataataataataaaattttttgtaaaagcattgtataataaaagtagtaagataaaccagtaaaaacaaaacaaaacaaaacaaaacaaaaaaaagttcaaagaggccgggtgcagtggctcacgcctgtaatcccagcactttgggaggccgaggcaggcggatcacttgaagtcaggacttcgagaccagcctggccaacacggtgaaacctcgtttccactaaaaatacaaaaattagctggatatgatggtgcgtacctgtaatcccagctacactgaggcatgagaatcacttaaacctgggaggcagaggttgcagtgagctgagattgcaccactgcactctaatgtgggcaacaaagcaagactctgtctcaaattaaaaaaaaaaaaagtttaaagaaaaataagttatttctccatgcttcaggagatatgtttcgcaggagaaagaggcttaatagagaaaacagatccctacaaacatttgtggtttttaaaactgccccattggttactaagtggataacatgagcgtgatgccagattcagtactctagtgagccatgcagctttgctgtgctctgcacctgatgagtgtggcctcacttcttataaatgcctgtcattgctaacaggggtccttgctgaaacaacagggctggactaatgctctagttcccttcctggaaaacctatcccaaagctgagatcctcatgatgccttctctcatatatgaatgattgcaggttacgctatcatcattaaatcgaaacattttagaccactttgcgtttgtttgtttgtttgtctcattatgtccagttttatcctgtttcataatttaataaatttttattgggtctgtcttctggttaaatgttgtgtgtataaaaaataaagtcaagagagagaacaggagttatggaactaatgacaaatccatccttcagctaaataaaattatactatggatgatttgagctgtacgttgagtgataatttttaaaaataagatagatcgggtgcggtggctcatgcctaaaatcccagcactttgagaggccgaggcggatggatcacgaggtcaggagttcgagaccatcctggctaacatggtgaaaccccatctctacttaaaaaaaaaaaaatacaaaaaattagccaggcgtggtggtgggtgcctgtagtcccagctactcgggaggctgaggcaggagaatggcgtgaacccgggaggtgaagctcgcagtgagccaagattgcaccactgcactccagcctgggcaacagagccagactctgtctcaaaaaaaaaaagaaaaaaaaaaagggccaagcatgctggctcacacctgtaatcccagcactttgagaggccgaggtgggtggatcacctgaggtcaggaattcgagaccagcctggccaacatagtgaaaccctgtctctactaaaaatacaaaaaattagctggacgtggtgacaggcacctgtaatcacagctactacggaggctgaggcaggagaattgcttgaacccaggaggcagaggttgcagtgagccgagattgtgccattgcactccagcctgggcaacaagaacgaaactctgtctcaaataaaatgaaataaaataataataaaaaataagataaagtatcacaagtaagatgtagttgaaacttcatgcatttttctatgatgcctatgatattcaaaagataactgaatttcatgagcagagttcaagaacttctgagtatacttttcattgatgacttaatgtaatggatttctatgatgatggcactatattcttttggtgtttatggtattaataaaaaattgtggtaaagcttgtggaaatgaacatgccttggattagggtgccttaaatgtgcctttgtaaatgcagctaggagactccaagtcacccttctagtctaactgctactcctttcttttacaaactacatgccaactaaactgaccttgatctgtttatgaaaaggcggtataggaacaggggctctgcaattggacagatccaattctaatcaatccactccattgatagatatataaccttgagtccttcctgtgcctcagtttcctcatctgtaaaatggaattaaaaaccaacttcgtgaggcttttggagaatgaaaatgacataactcaaagattattgggtatcagaaacaataatgttatctatcactgtctttactgttattattattattgtcattattattattttctctacctggaacaccaattccacaaactcttaatgtcaagaccatgctgtatcatggagccttccctgattcctccatatgaaaataattaattctcatattaataatattacttttctagttgtattttctttttttagcttttattttaggtttgacggtacatgtgaaggtttgttacataggtaaacacatgtcatggaggtttgttgtacacattattttatcacccagatattaagcccagtactcaatagttatcttttctgcctactcgtattttcattatccccaagtatactatacatatcttaaaattaggatccatgttgaaaaaacattgatatttcctatggcttctaacacagtacattgcacttagatattcagcaactctgtattgaatgtatgggtacaatctgctcttagtttctaatttggtattaatatgttcaagcctcaagagctcatgtaaatgatggtttgactatattgcccatcttttgttaagttgaaaagctgaaattcatgcactgtttgttagtgtagtaatttgtgacaacgtctagctattaagtcttttctaggtataaaacctttatatctgtcattgttcccctcttgtgtttttgctttaatatcgttgaaagcatctattattggaactttcacttctgaatagtacttttgagaacctgtatagaatttcagaggccttagaaaattgtcatagattgcttttagtatatggtttaccactgtggtctcttaacttttcaaaaagtatttccaaagggcacttacatccataagtggaaattgatttacatctattattgctgattgttcactattctgaacttcggctaaacaggtgatttaggcagaatttttttaaatattagattttttcctactttctaaatattttgtagctctttcttattaatttgagtcaacttatgctcgcttttttttgtcaattatagatggttgtcaggggtttggcaaatgtcatatgaaggtaattctttaaaagttgggatttttgaactgtttatttctactacttttgattttgctggaaattatcattctattaaagggacaaaagggtgctcagaaatatgcattgaaaaatttcttacagatttatcaaccattgccctcaggcactgatattcagccagtatgttccaatacatccatgtctttccattttaaaccttttaattctgttctaatttttcattgcctgtgcctgattgttctgtatccatctgatacgaatggttaagtacaacattttaaatatcactcttgcctatacatattatttttcttgtcagatgatataattgtagtcattacatgtttcttaagcacaactgaaatcttaatttaaatcaataagtcttgtttctgtggccattgtttcccagaactctccggatttctaagcatggtggttattcttccaggaatagtgccgagagtcttcagcagcatgcatttctctctaattgacattatttcacactctccattttccttactattgaaaactgtatttcattggtattttgccaaggatcctgctctgtttcataataatgttctgttcgcactctctgcactgacaaatacctattccatgcatcaattgcataaatggcaatttgaaagcatttaaccacagctggatatttttcattgattcttttcatctgaagatcattcattaggcttctccctcctgtttcttctcacatccatacctcctttcctcctatgtacatagtgtcttttgcattttctgtatttaagtgtaaattgctgactacagttatgcttttacctcattccatggtcataatgaaatcacaaatttaaaaatgtactactttttaaacctgttttctgacttgtccatctaaatgcaattttataattcttcgacattcagcctcctggtgaatgatttctgcaatctctccaagacatctgtgcagtgttatggattatattgattgcattttgtccatgttcaaatttgcagaatgtaacctacagaatatatattgactaataaagaaatgcatccacatggtggatggttgtaaagagaaaatatatattggtgtgcagcaggcgcccacacaaatgaaatctagaaaacagcagcttgccatgtcagagttgcaaatgaaggctgtggctacaaaacacagaaagtctggagtgtatgaaaggtttttcttccaaattcattcacacataaaaatgaaaaaattgaaaaatcatatatgtgcaccttaatttttatatcgcattggtgtttgggcatacgaccctgagattttcataccctcgatttttttaatataaccacctgagcgtttcttcccatggggttactttagaagatggggggtgtacacactacgtatgtatgtcaataaagaaatgaaggaataaaggaggaaagaagtgaagaaggctgggggtaggaagggagggagaaattcagtgattcattacttattcatcatcctaaactggcatataaaataatatgtttaaatcagtctaaaattttcattgtataatctctgaaataactagtccccactccctaaactgtttggtgtaaatatttatctatgtctaatcatttctatgcaaaatagccttatatatattttcattttcataagatcatctaagaatcaaaggaaaagctattttaggcaatgaacataggcagtgatttcaaaatagaatttgagaaatgcaaggatagatggaatcacaaaagatgatctcattcatggtgttttaaaccctacaaatagatttctgtttagttgacctcatttcaatagcttctcatttttttcagaagtgtatttgatgtgtatatttctaataaacttatttttctttttgtacccagtattaaggagcacagcatttatatccactgaacaaaggataactgaaaggaaactccttgatatccaacttggagtatttgtttctcgaatgaatatgagtttatataagtagtttttttcacatacataaaattagaatttgtttgtattattgatattatttcagaacagcggatttaacgtcatagatgatctagatgtgtcctttccttagaaatctttaaaatgaatcacatagtctagaaacagatccagatactacatgctctcatcagaaaggactttcttctcttcgtgtcaagttcagtgttggcaccgtatagacaaagcgtgttaaaatagcagggttcttgttctctgacacattacaagagaggcaagattataaaactgctatgtgtctcattataattcccattagtttcatttgcttcaaaacattcacttctgtgctttttgcaaaagctttcaaacttattttttgatgattctaaaagtaattcttctatgtcttttcctagtgatactagcattagttttcttttccaattgtactaggaggcatgagagattatcgatgccctattttcttgtctaaataggcaacccaaataatcatagtgacctgttcatttatattatctttatttcttgcctcatacttcttcatatttcttcatttcccatgtttccttattctttggagccagaaacgatcacgttaatcactctttccattagttttctcctatacattttctgatctttctctgagccagttaagagtcattcagccatttgataatggacactagtttactttgaccttgcaaacacaaataccctgtttgatctttatttgctgagagcagtaagacagaagaattacaataaactttttagcacccttctgttcaattctttttcagaaatcgttccctcaaaaagcctattctaggctctttcttttggcagtttcctagaattttcctttgcttttcaccaactggaacattatcactagaagtaaactaagggaccatctaattcaacaccctcgttttgtactttaggatactgaagccaagagaagctaatttttttgcctgccataacacaactagttagtgaagcagccaaaactataagggatcttgccaccataagctttatcggcccatccgtttatctcctcaaagcagccctatacctgatttccttatttctgttctctaagtaagccaagctcagaccttagagtgaccttcccctaatccaccctgcctgacatccaataaactgacaaatccagttgattatgaagctacagtgtttttcaaaccataccataattgtctaggctgttgccatgctctacacaccagttttcttattccagtccctccctgccccagtcccagttcactctactcagcctctctactgcaatggataaaatcacagtttccagattcacaaagctcacagctctgccactttctagccttgtatttgtgtttcagttgctgctgaaactctctaagcctattttccatctataaaatggaaaccaacccagaggctcgttgtattacagagatattgcatgaaaagcatttagcgcagtgtctggcccataagaagtcctcagtaaatagtagtcttggggaagcagtagggtgttgtagtaagagagcagagcaggggacagcaaactacaggtctcagtacaaattcaacatggggcctgggttttttttaatagcaggggagctaaaaacagtttacttgttttaataagttgtacgaaacccaaagaagaatatgtaacggagatttatgtgttcctcaaagccagaaatatttactttctggccctttacagagaactttcattaattcctgttgacagctgtcagggtatgaatcctctctaccacttagaaactgtgtaaccttgggcaaatgttttaacctctccaaggtttggtttccctgactgtgaatagtacctatgttacagggttgttatgagaattaaatgagatcatttatatcaggtgcttagctcactagctgaaataggatttaataaatgttagctgacatggttacgtctactcattgttgcagataaatagcctctaagtgcagctttaatagtgattgtttcttaaaatttttgaacaaagtttttctatttcttatccaattaaataaatattccacattctggcattcaatatttctaacgacatcaagcaactctaaaatcattgaatgttttaaagcaacaggaaaccttagaaataactcatctaaactcatatcatagatatggaaactaagggccaataaaaccaaggcttctaggacctgaaatcagatcctctctttttaggtagtgtgatcttcatcgtgcttctgccatgcaatctcagaatttaaagggatttaagaatcattcattttcttcctaaggcaggattcgaccctataaaatccctgtcagtttggtcattcaaacccagtttgagtacagtcattgatgataaatcacccttttcccagggagcagttctggttgtttcaaagtctttataataaatgaaaattggctttcctgaaatctctatatattgatctattcctgcccactggagccaaagagaaacgtcacttctctacatctgtaaaatactcgttgtcaattttcgtatcttctctaagcatcctcgtttcaagctgatgtgaactagttgggtttttgattgttttcattgtcctgctaagtcgaaaagctaagaaaagcttggctctttcatcactgttatatatcccactgtgtaacagaacttgagttcagggtatacactctaaataactgcttttgtaaaagtattcaattatattgatttttttcgttccctctgttgttcctcataattaccctcagtcaagactttcatcttcgtctttatcttcctctgcaagaattaacagtggtcccttttgtgaacttcaaatatctgagactggtctcagttaatttaggaagtttattttgccaaggttgagaatatgcacccatgaaacagcctcaggaggttctaacgacatgtgcccaaggtgtttggggcacagcttggttttatatatatttagggagacatgagacatcaaccaatatatgtaagatgtacatttgttccatccagaagggtgggacaacttgaagcaaggaggggcttccaggtcacaggtaggtgagagataaatggttgcattcttttgagtatctgattcgcctttccaaaggaggcaatcagataagcatctatctcagtgagcagagggatgactttgaatagaatgggagacaggtttgccctaagcagttcccagcttgacttttccctttagtttggtgattttgaggccccaagatttattttcctttcacactttcaatataagctatccagaactgatgataatattccagatatggcccaaccaatggaaatgattgtgtttcctacataccatatcacaatcaaacctgttttgcaccttgcatttactttctttattaatgatgtcattgcaatttagaaaatttggggccacatttacttcttcctctctattatcttcagtttttatttggtcactaaattctgtttgctgactcttatatctaaaaataaaaacactcaaatccagctattcctctctaactactctgcccttccctcagtcctttctcagtgactattaatgatttggccttctaatgattagcctccctgtccccagacttttatccatctttatcactatggctagttatcttgctaaacaacagatctaatcctagtaccccattatattaaaaaaatcttctatagctacagctttctctccctccaggtcagtatccatagcctgtcaagatgtggctttgataaaggacagaaggcagggaaattctgggcagaagagggcaggtccccattgaggacccaccctcaagccaaaaagcctggaaccatggcccaaagtgagaacttacatccctgttttccctcttgaagggtgccttttccaaaaccatccattaccccccacccaccccccaacctgtgcctataaaaaccccagagctcagctggcagaaggaggagaagcagatggatgtcagaaactacagttggacatcaaagagaagcggcttgactttagagggacagtttgacagcatagctttggagaggagtccagctgtggatggtcagactccaggggaagattaccttcccactccatccccttttcagctccccttcccactgagagccactttcattggcaataaaatcccccatatttaccatcttcaatttgttcatgtgacctcattcctcctggatgctggacaagaacttgggtgccatgcgtgtgggtgaaaaaggctgtcacactgaccctccactgagctgttaacacttaagccatctgtgaatggcaaagctaaaagggcgctgtaacacttcctcatgggcaccctcccctagaggctgctgcagggcccgtacggtgttcactcttgccagcactcaaaaatgctggccccagctgctgcacctgctcacctgtgctcccccttccatgaggggtggaccagcgagtgagtggagtttgctcccctccagttcccacccacgaagggatcagggaaatatcctccttcagctccagtgaggcacagtggtatacacctatagtcccaactactgaagaggctgaggtgggaggatctcttgaacccagaagtttgaggctgtaggcactgtggttgtacctgtgaatagccactgccctccagccttggcaacatagcaagatctcatctctaaaaaagaaaaaatatatatgatgtggctccaattcactgatctagcctcttaactgaattccttcctcctggctgggcacagtggcttatgcctgtaatcctagcactttgagaggccaagacaggagaattgcttgagcccaggagttcaagaccagcctgggaaacatagtgagacttcatatctacaacacattttttcaaaaagaattttttcctccctgctccccaccctacccccttgcaaccttatttactcttcggcctctggccctctcgctatgtctttctcagcttcatgcctttgaaaatactctttctatgcctggaaagcccttataaacctggaaattcctattcttattcaactctgagccagtccattttagtggcttagttcagaggctctagatttaaattgcaattctgtcagattctgtctgctttgccaacctcaatcaagttatgtactatgcctcagtttcctcatcagtagaatgaaaataatacagtagtgcttttttcatagggttgtagtgaggattaaatgagatgaagcgtataatcctcatgtacataacacagtacatactatatgtgttgcacatagtaagtgctcagttctttttctttgcattattcttagcacataagtcaagttacatttgctctcccttacgcaaggtcaattgttcttttttatgtgtttacccgttactttgttcatgcatttgttataaccactgccatcataaagcaacttgctatctttgttcataaaacaaatcccagattcactgagctcaaagtgagagaaggaaactttgcattatgtgcagttcctatgcttttctccaaatttcacatctccgttggggatctctcactagttatccttgccatacccccacaccagccttacaattttgcattatgtttcctacatcatgattctaaacggtcctcctgttcgctttctctccatcccatatcgttgcagatagctatttcctctttttaagacagaaacacatttgcattttgcctaagctacatttgtaaattttacagtattttcgaaagacacaatggaatctaggaaagatgcaacagataaagagattaactggccaatttttgagagcaccatccgtaaagtccacgaacaagtgaggcttccttgtcggagaaagcaattcagtcaccataaatgatcattcaagcctgatctcattccctcttgaaactggaaattgaaagcttgttcctctgacagttgtgttgtcagtggatatgcccagtgtgcaaaggactggacaaagggcaaaagtacacatatcccatctggaattctgagtcatccctgagacatcattttggatttgtctactgagatgaaattaaaacatgagtaatcaagcccacacttcttccccctcaaactcatctctttggtatcatcaagaaaatcaaatgctaatagccattgacctcctaattctagtgctcttagctatgataaaacagtcattaacttaatctaaatgttgcaaataaaggagccccatcaaagctgaagccccaaaattatacaaatgagttaactgggaaggcatgggggaaacaacagttttcataagacacactctaaatctagtttattctcttaggaagacttttctcatcaatagagagccacataaagatgccttacctgcctttcacggggactatatcaattggctgtactgtcactcactccaaaactctcaaaatgcctaacacagattcttgattttattgattgcattagatgttacgttttctaaattttcagcaccctggaggtcacctcaggaaatcatgcagtttttgaatgattttccttagaaatacacgtgtagctatacatatgcccatgcgttatttaatcagttagtgaaaggaggaaaacagcatttctattattgacctttctcaatctctgaggagactgtatgtcttgcctacagtccaggattgaaagcaaaagaaaaaggcactgacaaaatagcattttattttaatagcacattatggagagacaaaaaaaaaaaaaaaaaaaaaaaaaccctgggatttcctttgtctaagtagaattgacgtatgggtgagatcagtctctattttactcagtacaagtgcacacatatttatgtacacacatataattgtcatctttgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgtggttgcgggcgcctgtagtcccagctactcaggaggctgaggcaggagaatggcgtgaacccgggaggcggagcttgcagtgagccgagatcgcgccactgcactccagcctgggccacagagcgagactccgtctcaaaaaaaaaaaaaaaaaattgtcatctttggaagctaagggccctgtatcagagtatcagaatatacctatatccaggatgcaatgttctccagttttgcattaacatcagctacaaggttcactgccatctaagactaatcaacagtaatagctaaaggacaaaggtcagttcctgagagatatgcctaaattcatctggctatatcttctgttcctcccaaaccctaaccccataaattcttcattgtttagaaggattcatattttttgtttgtttttcatattcccattttattggctggggttagaattgcaatggcagcaaaaaacacagaagctatctacagtggcttaaataaatagagttttatttatctccaatattaagatgtctggaaataaggtgctttgggcccaacagtatcaggactggcatctgtatattttttattgacttttcctcatgcaatatagcagccaccattatttcacagggtgaaaaagagaaggcaaaaagggtgtactatctgagtcttatcatttttataaagccaaaaatttcccagaaaccttttttgaaagacttctacttgtatatcattgtgtagaactgtgtcacatgacagccaccaacaaaaagatggctagggagaagtggttttcaacaggtattgaagtagctaaccggcagtgtctgccggtcttcagttataaacaccagcagctaactctggctaattcaagtcagggaaaacaaaggggatggggtaggggctctttatttaaaagatactcatagaaatgaacgaagtaatttgaaaactaggtctcagaataggacatgaagtataagagttctaaaatctcaaaagcaggaacacatgcatcttctttttaagtgttgtctttgaaatactaagctccaaagtctttccaaccttgtattattttcttcctttgtcagcttcctgagtggcagagtctgagtaacctatggggtctttgaactctttaggggaattgaggaaggcaaaaaggtaccatgattggcagctctactagagtcacaagaaatatggggaaagcgattcctcaaaggaaaaacaaaaacagaaacaacaaccaggcagttagtagaaggatgaaatactggacccacaaagacaacatatgtcttctcaccacacttggtctctctctctctctctctctctcacccttctctctctctcatagtaatgaaactaaagctgcaaaactaaggcctagctattcattgtgatccttatgagatcataaaaaaaatctgtatttaagtggagaaaaataaatggaatatcaactttaaaaaattttttttgagacagagtctcgctccgtggcccagactggagtccaatggcatgatctcagctcactgcaacctctggctcccgggttcaagcaattctcctgcctcagcctcctgagtagctgggactacaggcacgtgccaccacacccagctaatttttgtattttcagtagagacagagtttcaccatgttggccaggctgttccgaaactcctgacctcaggtgatccacccacctcgacctcccaaagtgctgggattacaggcacgagccactgcacccagctggaatatcgatttaattgtaagagaaaaatgcactagtttaaaaatgtgtcctctttatcctcaggttttaaaaatatttttaaggtagtttagaaaaactgaagtgattatttgataaataaatttcaaatgctatcaatggaacaagaatggatattagatatcctgctaacaaggatcatatttttacaagttgtttctccaaagagaacagagctacagctgagattctggtgcgcataaacctttccatcagagctgtagtcacctaacaattcttatatcacaatcttcatatctcaatcccttttccaaataacttcatctttcttaagttgcatacaaatgttataatctaatatttttgagatggatatcatgtgtcataaaaagaaagccattgtaatattaccaataccaagtattagcaaatattgacatagctttagaataaaaataaacagagctcaggttctggctctgccatagctagctagatttatcttaagacttcagtttcctcatatacaaaatgttgatagtatcatcatcttgtaagccttgttgtaaagagcaatttagctaacagtaacagtgtttaacatgcataaagtgaagactcctttctgggctgataagaacgctagtttattcatttgcttatttctatatttttaagcttagagtctgaaaattttcagagtctgggagtcaacgtgtggggtgtgaattggaacttcaccacttactaacaactcccttttgtagtgcttccatttatttatctgttcaataggagtaataatagcactcgctcaaagagttgtctgaggattagatgagacaatgcttgcaaaatgcaaagtggagcacctggtgtatagttggtattcaataatttctagttgttgatatgatgatgacgatgatgatgtattctcttgatatgtgaatgctcatcacaccatcctatggaatatttgattttaagaaaaagttgggtttgttttttttttttgtttttttttttttttgagatggagtctcactctgtcgcccaggccagagtgcagtggcgcaatctcggctcactgcaacctctgtctcctgggtttaagcaattcccctgcctcagcctccagagtagctgggactacaggcgtccgccaccatgcccggctaatttttgtatttttagtggagaccgggtttcaccatatttggccaggctggtctcgaactcctgatcttgtgatccacctgcctcggcctcccaaagtgctgggatgacaggcatgagccaccatgcccagccaagaaaaaatattttaaacaagttaagatcatttactatactgtgccctaagatgaggtgaacatgtagatcatgagatctaattgattttagatgcagttcagttttttaaaagaatgacctgctttccatattaaaatttcaaaacaatgatatgtggagatgatgacagaatatggctgaatgaggtaccttgttatcctcaaccttttggctcagagacctcttccttgctggaaactttcctaaccttttaatgatttattaacattttgcatgcactctttatacctttcattaatgactagttcactgcaaatttttctttgctttatttcctattcttggtgtgacattcattctctatctgtttctatggaagcttttgtgatgcctcagagagaaagaattctgagtctttgaaataatgaaaacattactaaaccataaaacctagatttcaggagcctaatagaggattagagctttattacgtacagccatcttacagtttagccttcaagtctcaattgtggaatgatcttttgtcctttctctccagtgtgcatgtgtgcatacacatatagacacagttcgcgcttcagtcatataaatgggaagccacaaagcttcctagagtacccagatgcagaattagaagacccaatcttgacaccagggtcaggggatctgtggtttggggggacttgtgctggctatattgttgtcacagcaggaacagtttgtgtcggtatagaggctttaacttctagtaaagggatatataatgaaaatgtaagcaaccatcgtttatttttctcacataataggaatttaagagaaagatatacccaaaattggtttattagctcaacagtttcattcagaatccaatgtctttccatctttgcatttgctatccttagcctttggctttggtctttggaattgtcacgcgatggttataaaatggctgccacactccaggaattgcatcatgacagtgtgaatggaaaataaaggaagagtggcagttcttgtcatgtttcagaagcaacagcatgtctccctaacatctctttggccagaactaggtcaagtagctgcatctacctgcaagggaaactaagaaattgactatcagtgctttttaaacttttttttgtgtgtgtggaaatagataatcactagagaaaaaagggagagtggaatggttgttgatgaggcaaccaacagtgtctaccactctatttataaaccttttcttgatttttcctactaaatgtgtggccgttttttttgcttgctttttgttttttgtttttgagatggagcctcactctctcccccaggctggagtgcagtggcgtgatctcggctcactgcaacctccgcctcccaggttcaagcaattctcctgcctcagcctcctgagtagctgggattacaggtgtgtgccaccacgcccagctaatttttgtatttttaggagacatggggtttcaccatgttgatcatgctggtctcgaactccagacctcgtgatccgcccatctcagcctcccaaagtgctgggattacaggtgtgagtcaccgcacccagccaatgtgtagccttttagttcaaggacctttcattataaatcttcatagtccaaacacccggcatattgtctggcacaaaataggaagaaatatttttggacgtgccaaggaatttgcaagacagtgagacaaatagccagtaaaaatgttagcattaatatattattaaaaatagtgagaaatgctccaggcgcagtggctcatgcctgtaatcccagcactttgggaccccgaggcgggcggatcacttgaggtcaggagttcaagaccagcctgaccaacatggtgaaaccctgtctgtacttccagctacttaagaggctgaggccggagaattgctggaacccaagaggcggaggttgcagtgagccgagatcacgtcactgtgctccagcctgggtgatagggcaagactctgtctcaaaaaaataaaaataaaataaaaagaaaaatagtgagaaatgttatgaagacaaagaataggctactttggaagaataatagtgggaacttcttcatagtctaggaaggcctctctgaaaaggatatatttaagctaaaatctgaaggttaggtcagtcatatgaacagggaggggaatggaataatattttcaagacaatgacctaaaaggaggcaagtatggctaggagctaatgactgagggggtgagtggtacaggacaaggctggagagtttattttatgggtaagcagagaaataatataatctgacgtacctgtgaaagtacacctgagctgatgtacctgcaaaacatcatacaatctgatggacctgctgtataaatgagagattgaatgtggcaagagtagaagcaaagaggccaggtaagaggcatttgcagttgtcttgatgaaagaaaatgactactgggagtaagatggcggcaatggaaatagagagaaatgaacagatttgagatgtattttcgagacaaaatctgtatgacttggtgatggattagatgtcaggcatgagggattgaggatgactcccaagttttttttgtttgatcaacttgttgtactgtttgctgaggtgataaagatggaggaggaagcagatttggaaaagatcaacagttcagttttagacatgttcagtttgaaatgtgtgtgatatgtccaagtgcagaagtcaaattcaattatagctcaaaggagagacccgagctagaagcgtaaatgagaaaaatattgatacaaaatggaatttagagcatccagaatggaaatcacttagcatgtaaagagggaagggaagatggcctaggaccaaaccttgataaacttcaagaaaaagaagtcaagcagaggtaggagaagagaagtcagtcaaaaatcaaaagaatatgacatctcagaattcaaggatgtgaataaatgtgtaagtgatggatggctttcggtctgggctttttgttttttttttccattttaagttccaactttgctacaatccggctacgaatcccacaccctcccaaattatctgaggatgttaattgatacttgatcagaaagcagtgatttttaaaatcatatacttctaaattatctgagatatgaagcaatgagatagggaagtggctgaaatatgtttctctggctcagctgtcatgagggcttgctctagaatggcactcaagcacatgtttatccactgagctctatatcatttattccattagctgaagaaggaatctctcacactctaacttcagttctgttggacatgggaataaaagttagatgtatacagactaaactaaacagatggtagaaaaacaaaggattcttaaagtatattggagaaatgcatttctatggtcaattttcttgaatatcctaagatcaggtttcatgtatataattctttacatttcacaaagcacctttagatgtgtctattccatttaaccctcatcctaactgtgtgaagtagggcacagaagtgtagaaatgattttttaaaactcactaagctaatcaatggataatctgtgattataatagaatctgagtttcggcatctttatcttattccttactgcactatatctggaatggtaaatattgttcatctcacaagcaagctcttattgactgatatcagctgcctagagtggtttattgtaaaagagcataaagcaaattggggaagactacaatacagtgccataggctgattagtaatttctaccattggtattaaatgagaaaataatggtacaagtgctttacatttgtctgccattcctaaactaaggcacctcctgttatttataaggaagaatattctgagaagtttaaaagtctcttgttaaatcatttgatgacgttggataaaatggcttaaaataagaatatgcctgttgcacaaataatctacactcccccaagataatgaataagtcagctggagcatctcaagtttcaatatgtagaggatcaaaatgaaatagtcataaaaccccttgcagacatttcttgggcaggcaaactaatttcctagtaaaagaagttggaagttggacaaattgtatatgggaactttctatactacttttgcaaattttctgtaagtttaacttttcctaataggatgctgagattcagctcttccaatggtctcaaatgttttttggttttgttttgttttgttttttgagacggagtctcactctgtcacccaggctggagtgcagtggcgtgatcttggctcactgcaacctccacctcacgggttcaagcaattctcctgcctcagcctcccaagcagctgggattacaagtgcctgccaccatgcctggctaatttttgtatttttagtagagacgggattttgccatgttggtcaggctggtctcaaactcctgacctcaggtgatccgcccaccttggcctcctaaagtgctgggattacaggcatgagccaccgctcctggcctcatttaaccattttgactttcactttttctgtcttcaaaatgaggtattgagctaggtaaacttaatgtcttttttcgctttaattatctaataattctgtgattctcaacttggtgtgttaaaccagattacacctaagaaaccctgaagactttttagctaggagtttaaatattcacttagtcattcaattaatatctattgtgggtctgttatatgccaggcgccattttaggtattgataataaagcagcaaacaagacaaaacccctgccctcaggagagcttacattcttgtaaagaagacagatgataggccgggcgtggtggctcactcctgtaatctcagcactttgggaggccaaggcgggtggatcacgaggtcaggagatcgagaccgtcctggctaacatggtgaaactccgtctctactaaaaatacaaaaaaaaaattagccgggcttggtggtgggcacctgtagtcccagctactcgggaggctgaggcaggagaatggcatgaacctgggagctggagattgcagtgagccgagatcgtgccactgcactccagcctgggtgactgagcaagattccatctcaaaaaaaaaaaaaaccgaaaaacaaagaagaaagatgataaacaagtacacaattatcatataacaattttaaatagtgacagcatgttgaaataaataaagcaaggaagacgctagagagttgttcatggaaggaattgtcattttatataaggtgatcagggaaggttccactgaggaggtgacatttgaggaaagacctgaaagaagtggggagggagacccgaaagttcatgaggaattgtgtcccaaacagggcaacacataaaaagtccttgaggcaagactaagctgattatataacatttaaaagaattaggccaggtgtggtggctcacacctgtaatcccagcacttttggaggccaaggcgggtggatcacctgaggtcaggagttcaagaccagcctggccaacatggcaaaaccgcgtctctactaaaaatacaaaacttagccaggcatagtggtgcatgcccatagtcccggctacttgggaggctgaggcaggagagtcacatgaacccaggaggcagaggatgcagtgagccaagattgcaccactgtactccagcctgggtgacagagcgagactctgtctcaaacaaaaaaaaaaagaattaatttacatatcatgagatcatctagtctaacacccttactagacaagttcaaaaaggttaagacttggccaagatgacacagctatttaatgtgatatctgggttagaattcacctcatctgaattcctctcaaattgtgctctttgaggtcaatgtgccttttaaaaaatgacagaaagcatggctgtagatttcagatcataccaaatttgatggaacaatgaccatttttagcttcctatagagtctaagacttgaacttgccaagggagtcacagctggatttgtaagcatcaaatccacaaatgtacttaatgtcaaccaaggattttgtgtcacctgtaatgctcccccaggaagcccccaagtccactagtcctaatcactgtgtttggcttcataacctgttggcccaaacattacgcaaaaaagagcaatattcccaaggtggtcatgttagttgtggtgagatgtcaaccataagtagatctgaccgaggaaatgccttaaggaagcagctcaggaacacctgagtatatgtgtctagaatgaagcctattaaaaaaactactgcagagctaaagacagctgaaagccattatgacagtcacaactacttgatagattgaaaccaaagagttcctttgtgattagatagatcaggactctaaatcatgtttttacttcatgtgttcattcattcatcatacagtcagtgattcagtaaacaatattgagcatccattatgtgccaagcactgtgttaaattctggaaacacagagatggattagacccctgtccccagggagcataaagactagcagagttagacctccctcccatatgaagaaattaaatgaggtaaggcattaaaagtgctatgattacataatacagaacccaaaggggaaggcattttctgaaaaacagaaaactgaaaataccagcttttcagcctcacacagacataggaaaaccaacccccatcaacatcatctcttcttttttttttattattactatagtttaagttctagggtacatgtgcacaacgtgcaggtttgttacatatgtatacatgtgccatgttggtgtgctgcacccattaactcgtcatttacattaggtatatctcctaatgctatccctcctccctcccctcaccccaaaacagtccctggtgtgtgatgttctccttcctgtgtccatgtgttctcattgttcaattcccacttatgagtgagaacatgcaatgtttggttttctgtccttgtgatagtttgctgagaatgatggtttccagcttcatccatgtccctacaaaggatatgaattcatccttttttatggctgcatagtattccatggtgtatatgtgccacattttcttaatccagtctatcattgatggacatttgggttggttccaaatctttgctattgtgaacagtgccgcaataaacatacgtgtgcatgtgtcttcatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgctatttctccacatcctctctggcatctgttgtttcctgacttttgaatgatagccattctaactggtgtgagatggtacctcattgtggttttgatttgcatttctctgaacatcatctcttaatataaaaagcataatgtgctgatttcacattgcatgcctgtatcaaaacatctcatatgctctataaatatatacgcttaatgtgtacctacaaaaattataagaattttttttaaagcaacaataaatatcttcattagtcaaccaaattaaatctattaatatatccatgtttgtgaacaggatggccacagaaccctgtggatgcttaccacttaaacatttcctgaaacaaatatgtttccaaaacatcttgcctgtctaatctgacaactgcagacatcctaactaggctctgaaggtgctctccatagcactgatgttattgattcagttgttaacagcgcaggcataaatgactgatgataactctctaaacgtcccttcctactgccgttgaaatggctctgggctttatccaagcagggctgctaaatgaatagtagatgtaccagcagaggagaaattggtcctgaggtgaattaactctcctgaggtagatttgtttgtgcttccaacaacctgtacgttaaaccttgtgaaccttcatgtaggaattttgaggagaaatgggcaatttttggaaagcctaatgttttatcagccgctttttcttctcattgagacctgtgtattctcaagggactttggaagtttgccattttaagaacagacttgatgagaattatttgaagtcctccacgtttccatttatcagttttcctaatacagacatcctacgcacatcgttgaaagaatgttctttttgcctcacaggtagatcacaaaagtgggcccataatcattgggtagagggtttctcagctctgagttaaattgcagctgggtattgtttttctgtaataggatcttctctgagtgaatggtgaaacatgcccatttttgaggtcatgagagcagagctttccacatcatggacagaaaagggcaaccggccatggtttcagttatacagggagaggaaacaataggttttgtctctgctttgctattgcttcaacagcagcatactgttggacactcagacattagggcacaatttagacttgtttcacagctgtcatttctttcctcaaaaacaacaaacctgcatgggggaaatgagtctacatttcagggtttttcaagaattgataacataacatgtacttcaccatgaatttatattccacaggtccctgttctcttctctggtcatcagagtacaaaatcacaaccaaaaagcaagaattgatatctatgaagctaaagtagtagtagtagtagtagtagtagtagtagtagtagtagtagtagtagtagtgaagcaggatattaccctgatcccctcgcgggcgggaactggactgcatagccgcttcggtgctggcaggggcagactccactggctcagtctcactgagttccacccctcatgggagaggaagcacaggtgagtgggtacaggagccagggtgagtgcttttgggcgccagcaggaacaaaactctgtgtgggccccatggcagtgtctaggagggtgcccgcgacccttgaatccccagaaggagtgttacagggcccttttatctttgccatctgcagatggcttaagtgttaacagctcagtggagggtcagtgtgacagccttctgtactcgcacttgtggcacctcagatcttgcccattttccaggaggaatgaggtcacacaaactaattggagatggtaaatgcgggggattttattgctgatgaaagtggctctcagcaggaaaaggagctgaaaaggggacagagcaggaaggtaatcttcacctcgagtccagctgtccgcaatcagactcctctctgaagctatgctgccaggctgtccctcggaagtcaagccacttctctccaatgcacaaccatagtttccaacatccagctgcttctcctctgtgccggctgagcctgggatttttacaggcacaggatggagggcagggtgggctatgggtggttttggaaaaggcaacatttgagcaggaaaacagggatgtaagttctcactttgggccacagttccaggcttttaggcttaagggtggggcccttgccagagacccgccctcttctgtccagaatttccctgcctcctgtccctatcagtagtaatagtagtagtagtagcagcagcaacagaagtaatactaactactacataccaagcattatctacgtacttcatatctattcaccaacctaattgttacaactttcactcgcgtccgtgtgaagagaccaccaaacagtctttgtgtgagcaataaagctttgtaatcacctgggcgcaggcgagctgagtccgaaaagagtcagcgaagggagataggggtagggccgttctataagatttgggtaggttaaggaaaattacagtcaaaggggggttgtcctctggtgggcaggagtggggatcacaaggtgctcagtgggggagcttttgagccaggaagagccaggagaaggaatttcacaaggtaatgtcatcagttaaggcaaggaccggccattttcacttcttttgtggtggaatgtcatcagttaaggcaggaacaggccatttaaatttcacttcttttgtgatttttcagttacttcaggccatctggatgtatatgtgtaggtcacaggggatatgatggcttagcttgggctcagaggcctgacattcctgtcttcttatattaataagaaaaataaaacaaaatagtgttgaagtgttggggcggcgaaaattttcggggtggtgtggagagataatgggtgatgtttctcagggctgcttcgaggtggatcaggggtggcgtgggaacctagagtgggagggattaagctgaaggaagattttgtggtaaggggtgatattgtggggttgttagaagaaacatttgtcatgtagaattattggtgatggcctggatacggttttgtatgaattgaaaaactaaacggaataagagaaggagaaaaacaggtattaaaggacgaagaattgggaggacctaggacgtctaattagagagtgcctaaggaggttcagcatagccttgccagcaaagattatttactttaagagttaagagtggtggtttggggatagcaccaagagatatcagctgtgatggcttggagaaacagtgtaaaccagcagtgtaaacaagagcagggcatttatgactagttgagactggtgaataggagtatgactagacagaagataggagggatgacaagttttttggggtgcagtctaagttggtctggtgtctggaatgagactggggcctaataaaaaggagcgtccatacaggagcttaaatgggctgtaccttgtagcattctgaggacaggcctgaattctgagaagggcaagtggtaaaagtattgtccagtcctttttaagttggtggctgagcttggtgaggtgtgtttttaaaagaccattagttcactgaatactaagagcctgagaaactgcttgggtgatttgactaataaagtccagtctgttataggaccgtatagaggtgggaaggccaaaccgaggaattatgtttccctgtgggaaaggcctctacctatccagtgaaagtgtctacctagaccaagaggtattttagtttcttgactcggggcatgtttagtaaagccaatttgccagtcctgggcgggggcaaatcctcgaacttgatgtgtggggaagggagggggcctgaataatccctgaggagtagtagaatagcagatggaacactgagaagttatttctttgaggatagatttccacgatggaaaggaaatgagaagttctaagaggcaggctagtggcttgtactatagcatagcctgcctttgctggtgtgtggccattaggcctggtggaactgccatcaataaaccaagtgtgatcagggtgaggaacaggaaagaaggaaatatggggaaatggggttgaatgtctggtggatcagagatacagtcatgggggtcaggcgtggtatcaggaataatgtgggaggccggattgaagtctgggccaggaacaatggtaattgtgggagactcaacaaagagtgagtacagctgaaggagccggggagcagaaagcatatgcgtcaggtgtgaggaagaaaatagattttggaagttatgagaactgtagagagtgagttgagcatagtttgtgattttgagggcctctaaaagtattagggtggtggcggctgccgcacgcagacatgagggctaggcaaaacagtaaggtcaagttgtttggataaaaaggctacaggacgtgatcccagtccttatgtaagaatcctgactgcacagccctgcacttcagcggtgtgtaatgaaaagggttgggatgagtcagggagagctcgggtgggagcagtctctaaagctgtcttcaaggaatggaaagaggagtggggaaaggatttaggatctatggggtcagctaggtttccttttgtgagtttatataatggttttgttaggatggcaaaaccaggtatctaaagtcgaaagtatctaaccatgcctaggaggaaaaaacttgttgttttctagaagggattggggtttgggagattagtcagacatgatcagcagggagagcacgtgtgtttttatgagaattatgccgagataggtaacaggtgaggaagaaatttgggcttgactgaagtaatgggggctgtctgtgaagccttgaggcagtacagcccaggtaatttgctgagcctgatgggtgtcagggtcagtccaagtgaaagtgaagagaggctggggtgaagggtgcaaaggaatagtgaagaaagcatgtttgagatccagaacagaataatgggttgtggagggaggtattgaggacaggagagtatatgggtttggcaccacagggttgataggcaaaacaatttggttgataaggtgcagatcctgaactaacctgtaaaccttgtctgcttttaggacaggtaaaatgggggaattgtaaggggagtttataggctttaaaaggccatgctgtagcaggcgagtgataacagactgtaatccttttaaagcgtgctgtgggatgggatgttggcattgagcggagtaagggtgattaggttttaatgggatggtaaggggtgcatgattggtcgctaaggagggagtagaggtgtcttatgcttgtgggttaaggtggggagatacaaggggagatgtgaaggaggctttgaactgggggaaaaggcggcaatgaggtgtggctctagcctaggaatagtcagggaagcagatcatttagttaaagtgtctcggcctaatagggaactgggcaggtggggataactaaaaaggagtgcttaaaagagtatcgtctaagttggcaccagagtttgggagttttaagaggtttagaagcctggccgtcaatacctacaacagttatggaggtaagggaaacaggcccttgaaaagaaggtaatgtggagtgggtagcctccgtattgattaagaaggggacggacttaccctccactgtgagagttacctgaagatcggcatctgtgatggtctagggggcttctgaggcaatcgggcagcgtcagtcttcagccactaaaccgagaagatctgggaaggagtcagagagccttgggccagagttccaggggctctgggagtggctgccaggtgagttgaacagtccgattttcagtggggtcctccacagatgggacatggcttaggaggaatcccgggctgcgggcattccttggcccagtggccagatttctggcacttgtagcaagctcctgggggaggccattctggaggaacccctcgcagctgcagttcaggcatttggagttcttctgtgctggagatatggctggggtttgtctcacagtggagggaaggaattgcaactcagaaatacattgctacttggctgcctctactttattattgtacaccttgaaggcgaggttaattaagtcttgtggggtttgagggctggaatttaatttttggagtttaatgtcgggagcagattgggtaataaaatatatattgagaataagacggccttttgaccttttagggtctagggctgtaaagcatctcagggttgttgccaaacgagccatgaactgggcttgtttttttatttgatgaaaaagagcctaaacgctatctgatttgggataaagaaaaaggagcattaaccttgactatgcctttagctccagccacctttttaagaggaaattgctgggcaggtgggggagggctagtcatggaaggaaactgtaagccggaccgggtgtgaggagcggaggtgataaaaggattatagggtggaggagcagaggctgaggaataattgggcctggcgaggaggggagaggtcagatgggtctgtagaaaaggaagattagaaagactgagcgatgcttggggttgggactgaggggacaggtgggagggaaagaaggaagatttggaaggagttgcattgggaacagagactggggaggggcagatgtgtaaaagaatgcctggacatcaggcacctcagaccgtttgcctattttatgacaagaattatttagagcttgtaggatggaaaaattgaaagtgccgttttctggctatttggaactactgtcaagtttgtactggggtcaagtggcatcgcagaagaaaataaggcatttaggttttaggtcaggtgtgagttgaagaggttttaagttcttgagagcacaggctaagggagaaaaaggaggaatggagggtggaaggttgcccatagtgaaggaggcaagcccagagaaaagggagtagagacacggagagaaggggtggggggttcttgtcccccagaaaagcggagaaggggtagagacatggagagaagggttggggggttcttgcccccgagaaaagcggtacttgccgctaaaggtgaaggaccaaggcaggcgtccccgtgtggtcagacacctctgaaatgtgggtgaataatcaggcaggcatccccgcgtgattaaataccaagggaagactcttccgagtccgtgaccggtgccggagttttgggtccacggataaaacgcatctcctgtctctaccagaaaaggaaaggaactgaagttaagagaagggagagattgaagtggggcgccaagattgaaaggagaaagaggttgagggatagtgagaggttggaggagagagtaaaaagaggccgcttacctgatttaaaattggtgtgatgttccttgggctggttagtctgaggaccagaggtcgtaggtggatctttctcacagagcaaggagcaggaggacaggggatagatctcccaagggaggtcccctgatccgagtgatggcaccaaatttcatgcgcgtccgtgtgaagagaccaccaaacaggctttgtgtgagcaataaaactttttaatcacctggatgcaggcgggctgagtccaaaaagagtcagcaaagggagacaggggtggggccgttttataagatttgggtaggtaaaggaaaattacagtcaaatggggggtggttttctggcgggcaggagtgggagtcacaaggtgctcagtggggaagctttttgagccaggatgagccagggaaaggaatttcacaaggtaatgtcatcagttaaggcaaggaccggccattttcacttcttttgtggtggaatgtcatcagttaaggcaggaacaggccattttcacttcttttgtgatttttcagttacttcaggccttctggatgtatacgtgcaggtcacaggggatatgatggcttagcttgggctcagaggcctgacaacaacgatcttgtagataggtactgttgtaattcccagtttacaaataagaagactaaggtatagagagattgagtaatttgcccaaagcccacagctagtaagaagccaagattcaaacccaggtaatatggctgcagacctggtaatcctaaccattacattaggctgactctcgatagttaacttatttaagctagtgttaatcacatcttaacaagtttgagtaataaaatcttaggttgaaaggggccttcaagatctagtctaaatcctttcaggagttcttccacatttctgctagaaaacactttggcctaggcttaaaacttagtgatggggaactcctcactttgtaaagcagcctgttcagttcacaaacaccctaataattaggctgttatctcttgcattgagctgaagttgatcttcccataacctctgcctttctgtctatatgtatgctttggaaatatacacagtaagtgtaaaccctcttggcaaagacagcccttcaaatacttgggaggcattcaattccccccgccacctcccgctctactctcactaccaagtctttagaatagagtacaggtatcaaaatcaaaacaaacagggagtagaaacttagtgccagactttaagtattttttacttataaaatctttttgtgtaacgagtagagcaactcctaactgcatatatgtactaagtttgcaaatggggcaatttgtttttccccatgcactggcatcagaggtggtaaatgctggcctgtcagattcaatgcattttgctgggttagaaccgcaagggctttccaggggaccaagctctctctgctgtaatcattaaaacctgcagaatcctgtgtgactctggggagaagcccagtgctcttggccctcatccaccctcactaggaaagctgcttaaaactaggacagaagaaacaaccactggcttaggatcagtcctcagacctgccttggcactaccccttttattccaaattttgcagtggcacctccaacttcttggtcacgttttgtaccttgtctgtttcctcatataacttcattccaaattccaacccatgctctgacatttcctctccattcttgctagacaggaatttctggatattggatattggcccctgcccataccctgactctgtatattcttttgtcctgctgaccagtttgagcttctgaataacaaaaactccccaaccactttaaagtcctctactttagcttgatgggtccctctcctgtattttctgaccttgactctgctctctgtacaaatagtaattacactcacccccaagcagagaatctgtgtcaaaatccatcaggatatctaagcacatcattatatctgtcaacttccccagactcctgatctcaatcccttattttcaacaacctggcaccgacagagtataatttcttttgtatcatgatgcagtttgatgtgcttttcgaaaggttatggtggtgattttaaagagatctgttttgttagaggaaggaaggaaaatagtgctgtttgcttccatgcagttcctcagagcctatgccagggtgatttcagctcatgagagaatctaaagtctaaagagatgtgtggagattagaaacattggtgtaaaaaatcagattacggagacgtaatatccagggtgtcagaggaggcagggagcttcaatcatgtttgaaactataggtcccacccaacaggatgagaaaatacaggagaagccagaaaaggtacctgcttgtgggtaaaatcaattaaatggaatcaatggtatggtagccatcatttctttcttttcaaattgtggtaaaaacacataatgtaaaatttaccattttaaccattttttagagtatagttcagtaatgttaagtatattcatgttgtcatgtagtggacttgcagaactttttcaccttgcaaatctgaaactgtacccattaaaccacttctcatttcctcctttcccccagcccctggcagccatctttctactttccgtctctatgcatttgactattctaggaacatcatgtaagcggaattatacagtatttgttcctttttggactggcttatttcacgtagcataatgtcctcaagtatcacctattagctgtcattgcttgaacacggttttctgccaagcacatgatctcgttttattcccagcacaactctcaataacaactgtgtaccttttttccctttcacagattaggaataaaaggctctccaagactaggctcagaagcagaagcagttggagagttgcttgcagaaggattattgtcatactgggaagtgctctcaggatttacacctctaagaaactgaaaggggcatgactgcgcagaggaaaagctggttcaccatgcagttgcaattatggctgcagcaggagcatgcagggaagctctggagtaggtttggcctttcagagttgtccccagtaaatcaaatgggtgaagactttaacccatttatgctggaggttgcaaaaatgttttgtgaaaagtcagaccttggcgatgaccttgagcagtaggatataaaaaactcccacaagcttagcgtcccaataatggaacactaggcataaatgagttaatccctgcatcagccagtcattggccctaggtctctccctgagggaggggatgtagctgtgtgaggcagttccctgagggcacattccaatgaaggccccagctgtgagccagcagccaataaggcagcaggtggcccatgcatgcaaaggccctaaagaggaggtccagggtggagcgccacggtgtctactacagatgctgaaagagtaaatacattttatttatttatttatttattttattatactttaagttttagggtacatgtgcacaatgtgcaggttagttacatgtgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggtcttttgtccatgtgatagtttactgagaatgatgatttccaatttcatccatgtccctacaaaggacatgaactcatcattttttatggctgcatagtattccatggtgcgtatgtgccacattttcttaatccagcctatcattgttggacatttgggttggttccaagtctttgctgttgtgaatagtgccacaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtacatttgtttgagttcattgtagattctggatattagccctttgtcagatgagcaggttgcgaaaatttttctcccattttgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctgaatggtaatgcctaggttttcttctagagtttttgtggttttaggtctaacatttaagtctttaatccatcttgaattaattttcgtataaggtgtaaggaagggatccagtttcagctttctacatatggctagccagttttcccagcaccatttattaaatagggaatcctttccccattgcttgtttttctcaggtttgtcaaagatcagatggttgtagatatgcggcattatttctgagggctctgttctgttccattgatctatgtctctgttttggtaccagtaccatgctgttttgcttcctgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaatttccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgcacattgcttttgtatcctgagactttgctgaagttgcttatcagcttaaggagatttggggttgagacgatggggttttctagatatacaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttgtaaatacattttttaaggtcacacaaatgacatatgggacagaacagtgtttaacttcaaaactcatgttctttctgctatactgggccttctctccgaaagaggcctaatttgcacactacagtcaagcttagaatctattcatagttaaaatgtggagtcaaagcccaggaactatgtccttcaattcatctttcattacttacctattccttatcattcccgctgacaccaaccattttttctgacccttgtcatgaggagtgaagttgtatcattgcagcagctttctacttgtactctatgcctaaaatctctccttcctccatctggtcagccaattgctgtcaagttaatcttgcaagaacactacttttgccagtttaatttcgcaaaactcctgctgtgtgccaggagtgtcccagacatcaggtagtctaagataagcgatagtctctgcccctaagccgtttgcaacctttggagagacaacgtcattatcaccaccagcacccccattaagctcagagctaatatatgccagatgagactctgccagtcactgtgctaaggacttgacatacgttatctcccttaattctaacaactactttctgaggtacctctgatgagtagtatcatttttagatacaaaagcagaaacttagcgagttaagtgctttgcccagtggctctcagttgagaaacgaggtagtcacaccaggcagtccaacttcagtacctgagttcttaatcatcatgtttacaactttggctcaacattgtcaccaagatcgggttcaaatacatccattatcaatattctttctgtctccttgtatgtccaaacaaacaaaacaaatgcttccctcctgatgaggaaagtctccaaatcttgatacctgctgtgtctggacagtttttcctgctatttgctgagtgctggaaggattccctcaatccagatgtgattgcagatccagctcaagctcagcgtcctccagggaacctttgaactaaccacccagaaacgagcctttcaccggacactactcattttcacatatctagatcttatttccccatctgaactgtaagtgtcttaagagctgattttgttgttttttaataaaaaataattcttagttttttttcttattaccaaaaaattattcgccattgaagccttctgaatttttaataagaaaactattggtatattgcttcaaaaagaaatctaagcttctagattcttgaaaagggatagtgacagaaccttagaattaatattcaatataactaatctgatgaaaattcagtcattgatacattactgagaactactagatctcagcatttttaattgtagattcacatggagttgtaagaaattatacacggactccacatacctttttaccgagtttcctctaatggtacacctgcaaaactctagttcaatgtcacaaccaggattttgacgtcaatattgtcagtatacagaacattttcatcactacaaagatccctcctattggccttttatagccacacccacttccctgccccccctacctcctacttccagcaactactagtctgttttccatttctttaattttgttatttcaataatgttatatgaatggaaccatacagtatgtaatattttgggatggacttgactcactcaacataattccctagagatttctctttttatatgcagcaagacttgtttcctttttatcgtgagttgtatgctatggtttggatataccctagtttatttaatcactcaccccttgaagacatctgagttatctgtagttttggactattgtgaataaagctaccaacattaatgtacaggtttttgtgtgaacataagtttttatttccctgagataaatgctgaagagtgcaattgttaggtcatatggtagttgaatgtttagttttaaaactgccaaacttttccgaagcgtctgtactattttatattccaccagcaatgtatgagtgatccagtttctctgcatcttcaccaacatttggtgttgtcattattttttatttttagccattctgatatgtgtgtaggaatatctcattgtgcttttaatttacgtttccctcgtggcaaatgctgttgaacaacttttcctgtacttgtttgccatatgtatatcctcctcattgaaatgtctgttcatgtcttttgtctattttctaattcaaaagtttttttatagttcggttttgagagttctttctgtatcagatactagtcctttcttgtgtatagggttttcaaatgttttctctctcatcttttcatcttcttaacaggggatgaaaaagaattttaattttggcgaggttgaatttatcgctttttccttttatggatcatgcttttgtgttgagtctaagaatactttgcctagccctggatcccaaagattttctcctgttcttttttttttttttttttgagacggagcctcgctctgtcgcccagcttggagtgcagtggcccgatcttggctcactgcaagttccgcctcccgggttcacgccattctcctgcctcagcctcccgagtagctgggactacaggcctccaccaccacacccagctaattttttgtatttttagtagagacggggtttcaccattttggctctcctgttttatatgtcttatagttttacattttatgtttaagtctgtgatccatttgatttttatataaagtatgaggtttaagttgaggtttattttttgcatatggatgttcaattgctctagcataattatttgaaatggctggcttgattattgaagtaaggtcagacttatttctctcctgggcttcagacccagccaccttctatgtttcttgtccaccacaacctgaatgtcccacagacacctcagacttaacatgtccccagcagctcattattatcctccttttgtcccaatccaccctcaacatttttccctccctaattgtgctgttcttatgaacgctacgcttcacccaattgcccaagtcaaaaattagggtattatttctgaatctacttttatctttaaatctaacatgatgcattgccaaattctgtcagctctatccccaagccatctcttaattcattcccttatttacacctcccttgactccaatatcttttgactcaaatgctacatagcctctaatttatctccctgatattgttcttgcttccgaatcccttttccacaatgcgcctatagtaatcctcctaaaatgcagatctgattaggtgactctccttattttaaagtctttcttattgttttctcctgccctaaggcagaagttccaacaaatcttgttatcagattctggattaaatcccggcctcagcagtgggacctaagatagtgcctgaatttccatgaacatttattgatgacaaagagggtcttaaataatgagtgatgtagactttccactgtcaacatcacagattctggtttttaatggtattcacatttgccttctccaagagtccaggtttaatgatggtgagacctatcctaagacctggctttgtagtgaggggttacctcatcacagaatcaagaagggacctcgggccgggcatggtggctcatgcctgtaataccagtactttgggaggttgaggtgggcagatcacctgaggtcaggagttccagaccagcctggccaacatggtgaaaccctgtctctactaaaaatacaaaaattagctgggcttggtggcacacacctgtaatcccagctacttgggaggctgagacaggagaatctcttgaacccgggaggcagaggctgcactgagccgagattgcaccactgcactccagcctgggcgacagagcaagactctgtctcaaaaaaaaaagggcggggggacctgggtgcaagtaattctaagaagcaggaataagagaacaagaagaatgaagcgacaaagaaagatgagcaattctctggaactgttgagaagtgtacagaagaaaacaaatctggatataggtagctacagcctgaaatatggaaagccagagcatgtgtatacctgctcctgctcccactggttgagaattgattcctttttcatctgatatgggcaagcattggatctgagtgggacacatcctctccagtgcacccctgccttttccgctgctctgaacttcacacaacgtcggaaagattcaaaacaatgtagaaaatctaagtataaatacaaaaaggaaacaagaagtttttctatcaaagctgtgaactatatgatatgagtaagctcaataaacactgtgcagaagttgggaggggaaaaagagaattgctgccaaagcactaacccctgtggctggctatgcttgcccacccaggaagctcccatgtcatgggggtcaggggaacctagaacagaaagctgaaaggctcagggatcccttttgagaagggatgctggctatacagcacgagttagaacttgcacagaaccgtccactactgctgacactggaatcacaggtgggctgacaagatgtgatgcaagcaccagacatatttgctacaaacctcaaagtggagcagagcagcggcagtgtcagtcttcttggtgtcaatagaatacctgtttatttgttgaattctccctatatgaataataataatacaagaattcaaagcaggataggctttgtgtcattggaggagtatggagaaccatcagtgcagtaagtgtcgtgggaggtttctagacagtttttaaaagtcgatattgagtcaaccatcaaatgtgaacaattctgatatgccagagcatttgtattcttaactcatggggttattacaaagatcaaatgaaataatcattataaagcactttgtgcagtgcctggcacaaagcacgcactcaatacatgttaatgtttatacaattattattattgattgtcagaattatcagccccacatcagcaaagaatagtaggtggtctgtcagcaggaacatggaaacattctcattacatagaagtcagtgttgcagggacagtcattaaaacaggatctaattttagtcttctgagggaaaatgctaggttctccggaaatgttgaatccttcctcgagcatgtagtttaatttttcaaaattatattgcatatcctgtaaaatgaaaatgaaattgtactgctgttcattaaaggcccccaaaaatcttaggcactatacaatataaatgaaaaaaaaggcgttatttttccatagggcataattagaaataaagaagcaaggtcactcacaaatttccgagctataaaggaggaaaggaacaagattttcccccggttattttatagctgccaggttgaactcatacttatccaatgagccccagaatggaataccgttctacaccaactgtactgatgatagtgattcagggagtaaatgataagattccatccttctaaagtgcttttgggattggattctagtaagtttcattttgctattggccaatcacaaaagagactacaatagagaaaagtgaagacatcatgctgaagacagactgctgcatagaaaaggaagagggaccccctaatttagagatatggatggagaaaaaaaggcacttatgctgtagcataagggaaacattaaataaagctataatagaggagaaaatgtctttgaatagaagaaaaaaatcagacagacagaaatagactaaaatgctaaaaaaaaagatacaaaaggacattgaaggggacatacagtgattattacacaaattaaatgcacacagttaaaagggaggtgaaaagcttctaaaaagaatgagtgtgtagtgaacttaattttatcatctttactaagacaaagttaaagtccctaaaatattttaagacacttaaaaaaaaaagtcttaaaattttgagagcctttcagctctgtcaactctagactttccctcctacttaagttttttttcttttttttcttttatcttttttatttatttatttttttttttatgttttttttttttttttttttttttttgagagagagagagagtggatcagccttaataagagaatggtcttctgccaggtggtattctcctaatccctttccagtgagatccacaagggttcaaaaccactttctggggtcttagaggcaccacttatctctcttcctctgctcatatctttctgctccagtgcccgcatagtttgtgttatcagtggtgcgtagcctgagacatccacgacctatgccagctctcgaagtaatgtgattggcatccaaagaaacacaagaagcccatgatttcgtccctttgcaatttaaaatcatatttaaaatgccttttggtcatacaaatttgaaaatgatcttgtaaatcacttccgggaatctatggtcaaaactcagcttagagttctctacttcttaacagagtgcctgccggtaactagtgactgtcaatgagtttgaaaacataaattgatgtgcaaatgctagataatagcaacatcctgtgcaactgggcagcatttctgttgtttggcttttttattttcgtggactctcccaatctgagagaaaatagatttgagttcctttttaatcggtttagacccagacaaggatttaattggtttagaccccattcacctacgtgtgtcactctgtctccaacataacagaggagatgaccaagacaacatgctctccagccaggaggtggggaatactttggtgtcatagcagacaattattgatggaaaactcatgttagaaaatgtaaggtaccttcttctagacggagtaaaaggggcagctgcccagactttcattttaaatagggagcccatgatacaaatcttttaatacaattttaaaaagaagagacatagggggtatctcttaggacctgtcaacaaccaaccctctatcaaatggccaaatcacaggtggtctgcagcttagccaaaatgtccaagtacctttttgtaacacagaatctcctttgaagatccagctttcattaatgatccccagcagctctggtcaatgtgtcttttcacaaatgaagctttttaaaagctttcagtggacaaatgtggctttgagttttcaactaaatctttctgtttaaaaggagtgctgaaatgggcatactttataatcttaaatgctgcacacaaaatactgaaatattattgaccctgagaggttggttcaaatcaaatagcatactcacgtaaacgttctcttttcctaatattagcaacagggaatgtgaaatagagaggggcgggatatgctggataggggtgcaccaaaattttcaaaaagcctcgaaactagtgtatattgataaccttgtggcatctaatatctagtattctttttttttttttttttttgagatggggtctcgctctgtcgcccaggctggagtgcagtggtgtgatctcggctcactgcaacctccacctcccgggttcaagtgattctcctgcctcagcctcctgagtagctgggattacaggcgcccgccaccacgcctggctaattttttgtatttttagtacagacggggtttcaccgttagccaggatggcctcgatctcctaatctcgtgatctgcccgcctcggcctcccaaagtgctgggattacatgcgtgagccaccgcacccagcctagtattctatgtctattatttcttcataatgagactgggggaaatctttggagaattaatgccgcagttggtaaaatcattctataataatgggtaccattctgctctgtcccacatttttatgaagtctctttaaatttaaaaaggcaatgtgctttgtggttcttgagcaacttaaatacgttgctctgaatagttattgtgatgaggtaatttgtaacaacttttaggatcaatgctaattttcttaaatgtttctgtagtttcccctttattataaagtatattaggctggactcttggctgtaagtgacagaaaactcaactcagattagttaagaaacaaaagggtgttggtgacagtggtggctttcagactattgctgcaggcccacctgccatcctcttaacaccctcaacataccctgcagaaaagagagagctactctgacccgagagcttaaagactggtcaagtatgggcttgactctttatggcccaaattgggtcacatgcccacctaggctaggggaatggaatcgtggaattgattgattgattattgttgcaggttgagtcctccaagaagcagatgccagggcagatttattgcagaataacacctgtgaagaaataggggtggaagcagaattgaacaagggaagccatcagatcacaatgcagatcttctagactctgtgtcagcacaacaaggaatgccagagcaaagactgccaattagaggaatactgaattgggcagatctgacaatagtctgtatataactcgggactgttaacttctccttcctcaaccagttatagacatagaataggactctcttatctcaaacatcaatatctgtgtatatgaagtagagggtgaaagtttactgtacactagtggttctcaaccaagagcaagtctgtcccccaggggacatggcaatttctggagacattttcagttgtcccaactggtgaggaggtgctactggcatctagtgggtagaagttgtggatgctgctaggcattctctataattcgtgggatagatagcacaacaaaaaattgcccaggccaaaatgtcaataatgctgaagttgagaaaccttgctctataaagatacatgtcttggccgggcacggtggctcacgcctgtaatcccagtactttgggaggccgaggtgggcggatcacgagatcaggagatcaagaccatcctgggcaacatggtgaaactcatctctactaaaaatacaaaaattagccaggcgtggtggtgcatgcctgtagtcccagctactggggaggccgaggcaggagaatcgcttgaacccgggaagcggaagttgcagtgagccgagatggcgccactgcactccagcctggtgacagagcaagactctgtctcaaaaaaaaaaaaaaaaaaaaaaaaaaagatacatgtcttatgtgtactgaaagaggccacggaaaccttttgttgatacattcttgatagtttttgttcttatatgtagttatgaatacttgagattccatccaatttatttaacttttgaccagaaagggtagattgaattggtgaaacatctatatcctgaatatttaaaagattctgttttttaaaacaaatattaacttgaattaacgtaaatattcttagtagttaaagtccttaaagaccttagtttggtgaacagataagaatcatctgtgttcagcatatgcattgccttatgaagatggtaagtcaaaagtatgagtttatttctgatatttaaatatccctgaggtatagatttgtttactctggaagtttactctgttgtttgtttgtttgtttttgtttttgttttttgagacggtgtctcactctgtcacccaggctggagtgcagtggcacgatctcggctcactgcaagctccgcctccggggttcacgccattctcctgcctcaacctcccgagcagctgggactacaggtgcccgccaccatgcccggctaatttaatttttttgtgtttttactagagacggggtttcaccgtgttagccaggatggtctcgatctcctgacctcgtgatccaccagcctcggcctcccgaagtgctgggattacaggcctgagccaccgcacccggccttactctgttgttttatttcttcattatatattacaaagttgaatgttagggccaggttagatcggaaaacaagttaagtattccttatccaaaatgcttgggaccagaagtgttttggattttttatttttgtggattttggaatatttgcatattcctcatgagatatcttgggatgggacccaagcctaaacatgaaattcatttatatttcgtatataccttatacacataccctgaaggaaattttatacaatattttaaatacttttgtgcgtgaaacacaaaagttttgactgtgacctgtcacatgaggtcaggtgtgaaattttccacttgtgacgtcatgtcagtactcaaaaagtttcaaaatttggagcatttccgattactttggaaaagtctagaaaaagtttgatatcagtgcactgaaatcattttcaagtaggaacaatagcgatactagccctttactcatgcaaaattcacagtttttatctaaacaacacaaaatcattcaatgcttttatatttaatcatctatattcacctaaccataaaaaatcaatttcaatacagtaaggaaaagacaagaaaacgaatcattctaatcactgtattttgaaagttctttgcaaacaaccgtgaaatggttaaaagataggaggatggagaccagcctggccaacagggtgaaaccccatctcttctaaaaaatacaaaaattagccgggtgggttggcgcatgcctgtaatcccgggtactcgggaggctgaggcaggagaattgcttgaacctgggaggcaggggttgcaatgagctgagatcatgccactgcactccagactgggcaacagagcaggacgtctcaaaaaaaaaaaaaaaaaaaagatggtaagagaatgatgacttgttgcttactaaaataaaggaaagattgacactataagtgatactgtttgaaatctcaggaatctctgaatcattaagattatatcacaaatggcatgcaaaatacctgttcaaaaaatactcctcatggacatgagatgctaagctgctgatactgagtctgacctaggacaatgatgttctgtgtcacctcttttctgatgcctcccagattgctcctggcctcactgctgtctcacttccaaaaatacatattgcccttattggtcataacacagagactatcagttcaaaagtctctaattcgtctcagctgcagtcatctcccagcaagacacaaggttcttgagaaaagaaatttttcatgtcccatctttgccatccaccacacgatgaacatacagtacagtgtacatagcagcccttgaaaatgctggtggaatcattgattcttgaacccaactgtcatactttccagatttaagtcctggtaaatgattaaaatcgtatgggttaccctcaacaaaccagctcaagtatttactataaaaaagggaagctagatatggaacttcccctaaagatgggtctgtcaaactcaccccattgtattctgctctgacaccatgttttttgtttgtgttatttttttttaagagacagggtctcactatgttgcccaggctggtcttgaactcctgggttcaagtgatcctcccacttcagcctcccaggtcactgtgagagattacaggcttgcaccaccatgcccagccccaccttttaatacaaataagtaacagttaccatttactcagtgctcaccttataacagatgctgttaaacgctttacacgccttagctcatttttagttaaatacattgtttttgccccagctatggtagggatcttgctaacaatgagaatgaatgataagaggggctttaaggagaattcactgccacacctttcataattttcccatcattcctccagtctttgttcaaccgtccatgatttactgatttgctattacatcaaactatgctgcaacaaaccagtggttccttctgatttttatccatctcctcctcacctagggtgagagtctgaggcttccttgagtctactttctgatattgttacatttaacacagaacatctcttgttttcgtttctggcagcttatcctctcttcgctttctccatgctttcattcatcctaaaacaccattctgacaatgatatttaggttggtacataagtaattgtggttttaccattaccttcaatggcaaaaactgcgatcacatttgcaccaacgtaatatttttcttacttaaaaaattaatgtagagtatggaaatacttgccatcagggaatggggaagaaaatggctagagagacatggtgaaagagagacttgatttttaaataactttttttgtttttcttgaattttattatcatgtgaatgcatttgaaagaaatacaattttaaaataattattaaaaaaatatttgaatgccttcccatgaacaactaaatgaagtctctattcttaaacctgacagtcaagtacagctctggtttgactccaagctacatttctagccttgtattattcaactctttttctgtttatccttcatatccgggcctttactagtgccaaaaaaaaaaaaattgctcattctactcttgtcacccagagtgtttcttctgtttttgcccatcaaaagcttacccaattgtgaaggcccagtttcaaagcaacctccttcattaatttcatccagatactctgtaacccccatagctgtttaggcttgttctagcaatttgcagttatcagaaaaatgagtacataccgagtgccagaaagtggtctctccaactgtgcacattacaacatctcattctctgtgcctccatttcctcatctgtaaaatggtcactatggtgtactttcctcatagtgatgttcattctttcaagtagttagttaggtacctactatgagacaggcactgacctgggtcctgggggtacagtaatgaataaaatagattgagtcctgccctcatcaaatttaccttctgataagaaagacataaatgaaatatacctataatgctcttgaaatagcacttgggatatagtaaatgctctataaatgtttgctattattactgtcattgttggtagtgttgttatgtggtatttctattaacacataaagaaactaaggttcacaggctgttagataagatgctggttaaatagctagtaagggactccaactcaggtcttcctgagtcataaaattcgtggcatttccactacactgatggatgtataccaggctgtacatcagaactatctgtggagacttaaagaaagtaaagattctcaagcctcagcctcaaattaactaaatcagaaattatttagacgagctaagaatctgtatttttttgaaaagttctcaaatagttgtgatacactgtcaaattggggaatgactgcactacattaaaatctttcccataatactttattatgcttatttgtaaatatcaaatctacaaattcactaaagaccatccccttgttttcttatttatttttattttttctgcttcctctcctagcaaagtgccttataaacactcaataagtatttgagtaattaatggcttaattatttaaagttgcacttaaaatgcaaatactcacagctgtggtactggaagcctgttatgaacaatcatttatcttcctagggttatttactaatcagctaaggacaagcagttgggaaagaaaggctgactatttgggaacagaactgagaaggccctcaaaccaaatgttagccacgttattgaacagcctagggccccgccttaactttacctacacttcgttgacaatttcaggtaaaatgcagaaaatatacgctaacaatcaggagattcctccctcacaccattgtagtttcatttcttttaagccgacacatgtctctcttatggaaaatatgggaacaacctgttttaaagaaagaaaaagaatcctttattcttgtcacaccacaaacatggagttcactgctatacgttaagattataaagcaaaatcccaaaaacgcagtgactgattattcacagtagacatatgaagtcaggaagcttattttttctctctttgctaaggcacaaagcctggggctatatgcatttttattacactgtactgtgttgatttcacttgaggattaaaaagagagttgaggcacagtgcacgtatcttgatggattttaggatttcttgctttcgtgaaagaaagaagcttataaagtacctcagattatcgcccagggaagtgtacctacttccatgatgacctagaaattcaatcttttgtttctcctataaaagatcacattgtactttggatgttttccctgtagttttctgcactatgtaaagccacatttggaaaaacaaaatagttttagtttagagttgaagtgaaaatatctgaaatagttcaggaaagtcttatgagcatttggggagcttacaaacagccttgggggtggggtgagggggaatgagggaagagggaggcagggggagagaagaggagggctaggtcagaagtgtgcaaagaagacagagggagagagaccgtagagactgtgagtccatggcagagttttaattctggttctcacacatctacacagagaaacaatggaagcacattgctccatcccctgtcctttactaagaagcgtgaagtaaataacttgtggcttatgatatgcgaagaagagagaagacagaatgttgtaggatttggaagtacagtagatgagatcttccggtttattgatttgtaaagaacggcttgatactggtttgtcagttctgcatcagtgagagaaaagaaaggcgcttttcagtcacttgccagaggaggagagccgggaagtggaaacagggtcttctggcggacaagcttccttgagtggtggtcaaattgactgtgaagggagtcaaggtcaggaagctttggaaatgctgcaaggatggtacgggatttaaggagggttgatttcctcggttaagggttgttgcagacttcagcaaattcccccttccagcctttattaaagaagtgtttagtagaacaaactgaaaatctacaagtatattgttacccaaaatataaaagcttctgccactgagatgaaaatgtttgatttccagtgctttatctttttgcatttatctacctgtttcagtcattcgttaatatgaatttcctaatatatgccgtcttttttttttttttcggacaataccagttctatggtatctcactgatgattatttcaaattgccacttttgttccttggaaatactcctgtgttcaaataccaggaggcataattatgtaattaccatgtgaacattatgctacttatgggccaaaatgcccctagaaaggaatgctccaatggcctcagaaaatttctgtgagaacgatatcttccaaatgtggtataaataaagctcaagaataaatagctaaggctggaatgtaaatgatttaatgtaatgatgttgtaaggtgagagccacttgactttagttcctgttgcaaatcatgagatacattaggaaaacttttaaaagggaacctattttttaagataaaatctgtatcaagttacatcaccttccaggcaaagtaattcaactttcctcttttctctctgagaccaaaaaaaaaaaaaaaaaaaaaggcagaagaaatgcttcctatgatctcttctcttcctgtcacaattttcataagtctgtagatgtaattaaaactaaagattttgacaaatgaaacaggataggaggttgattgctgcttttctaaattaaaatgaatgatacccttaaggtacttgggtctatgaagtcaatttaatgttgatataacctgactccattatcacagaatgaggcagttgcataagcaagaaaaccaataaacaaacatccaaagtgcattttagaaatcggtgaggtgaaagattaaaggcttaacaacggacaaagagcttgctgttttgttctctcttgccttccagtttgatggcagagttcatcagaattagaggaagaatgttcttggagaagcgttgggctggcactaggctaggagtcctattcatatcctgcctcgcttgtcttgcaagcatgcacagccccttcatttgaggcactgtttgcctcagcagagtctgtgtactcttctggtaggttgtatagaacataataaagggggagggctggaggagaaaggacagaaaaaggagggaataaaaaaaggagtcagattaagaaagaagtcagcacagaaatataaaatggaaggaaaaaaagctgtgatgcaggaaccttaaaaggtagattaaggatggtctcagatggcacggcattagtatcaatgccataagtcacacaaaatctattaagaattatgctcctactcagagtgagtgccatgttagcactagttgtttcccgtgatctatcctgaagtcaaacgcaagaaacactgtttaactcctaagtgccctaatgtcaggaaaacacagaaataaactcaaaggaaagacaattcagttaatctttgcattcaacaagcccaggttgttttgccgcagagctatacctatcacaaaacttcattccagaagatggccggtagaggtggctcatgcctgtaatcccagcactctgggaggcccaggagagtttgaaatcaagaccagaacttatctcagactttttttttttttattattttttcagttacaactcaaaagaatcagaattagaataataatggattttaactgaaagggattaccattagttaaaaggattttaactgaaactgtaatcagtctcaggagcgtttcccggataatgtttgggcacgtatttatgagtgttacttgtgaggatttgggagtaagaatgaacgaggaagttcctcccccaacacagacacatgcacacagaaactgtacaaactgaaaaacttcaggacaaaaactcgtgaatagactggagagtcatttgtgtgcatatgtgtggtttatttactagcatcacagcacaagagtttctgtcttttgcttttgtttttgttttaataggctcatttgtgtaagtgtcatgtctgtttcttgcattcccatggatatttatctagggtctagacaaactgagaaccagaaaatcaaaacatacgttcctagttacatattttctctagactggagtaaacatgatttatgtatgtagtaatcagtaagatgtagcttggacactaggaagaaaccacattgcctagcagtgtatttccacatggggaggtaatgcctgtctctcctaaacttctagtgaagataaaactcaaagtagagtaattaacagaaaggtcaaaagacaaagtggaagcccttgagaatctaaaacaaagttaaagaaccaacatttacatttagataaatttatttgaaataatttctaagagccatgatgttgttatcggtcctttttctttctttcttttattcttttggcttatttaaaagcaatgttgaagaaaaaatgaaataaagcttatctttcacaatacacagaggaatggactgagctttgggaaacagtcacagcttggaattaagagtgtgtgtcgtatcgtaatttagttggatgatttggtgctcattcattatacccagaattacgctttcaagtctaccgtattcatacttatctcagtgcctgacaaataagaggaactcaaaaagcctttcattcattcatccattcagtatttcttgatcatcttctatgtactaggcattgtgataaattcttaacaagacagataagatctctgtctttgtggacaataaacttacattctagtcaatatcttttgaatgaatgtagtgatatttcttactgaagctaagaaaggaaggtctctgcaaacagtatactgtctacagaactcatctgaaatgagaagaccaaggagaataatatatagccctcataactctcaaatcttaaatatgattatttaaaaactagagtaaaacaaatgtggaggagatttggacttcagggttgttttataaattgccgttttacatttttaaatctagtattataggcaaaattgaatctaaatggttttcttcttttcttttttttactttcatcatcaaaaatggaagaaaggaagaaaaggaggaaggaagaaaagaaggaaaggaagaagggagggagggaagtttttcaaaagcttgtgtcagggatcttgaaaaagaaatgattcattcaaaatatagttgttaatagtaaagatccgtgaataaacagtacattaattcattcaactaatattaatttagcacctattatatgccaggtactgtgctactcactgaggatttagcagggaaagatgtgtccctgtcctcatggaacatataaaaaaggacctttttttcctgagatgcttttactgaagaattgctgcaacctagattatgagttctcatggaccagatggcagttttctgcccatctgggatagttctgaagaatagaccctcgtgtatcaatcaaggtttcttccagttctaagctttcgtgatctatgatctaatagttgaaacaggatgtatgcttccaaaaagatgttatatttgtattacttttataaaaggaaacagagacatgccctattaattcagaagagattgggttcctcctggctgtttaaatcattctatttaaactcctttatctcttctttcttggctcaccttccaaagctcactcttaccccttttagtctcacttccctttcctttctttaattgctgagacaaattgttcatctctaactggctatacatgacatctccagttaaatgtttcactgttaggacaaattcattatgttccaaatgaattcatacatacatatgctatttcttccttttctgattttcatattgccaccagcaatatcttcattctcccagtcttccttactcgaaatccaagagtttatttgcttcttcagatattaatctccaacaccaaattggatagttcttcctcctttcaaaataccttctcatatgtaccttcttttacattgaatacaatacagccttaattctaatgcatatcaacccaagtctagtaagttacaacagcctctttctgatctcagtctcaggtgccctttcgaatctgttttacactatactgatcttcccaaaccctaactttcctctaaaatagtgagtcatgtcacagaaattttcagtggttctctttgcctgcagggtaaatcttgagcctcagagtctgggacgccttgctttgcatcatcggctttcaacatgactaactaattgtatctcactgtcgtcctcaacaccactgttctgcagccccaagcctttcttcagcttgtcactacttcttacctccaaacctttacacttgcagagatcagggactatagcatttgttttttgcctatctctttcaatattaacaaatacttataaaatgaataaaccaccaaggaaagaactgattgtgccagaacataagacacaggtatatcatttctggcttttgcttcctgttttgtatataccacggtatattgatttaacatacagccagttagaaagatctaatgcatggaggctctcgtttaatagattatcaaatttcatttccttgcataattgctcaaagaataaagtgctttgttcctaagtcccaagctaaagctttcgaggactttggttgctttcaagtttttctcattcataaatttgtttctttatttagccagttgtgcattcaatccacacaaaacctttctccagtgataatttgtggaaagaaatattttatgcttaattcttctcgctgtcataccttctcttaagtttgagttatgaagatggaaattcactttgatctcattttaaaatcttgacaatattgaatgtacactggaaactaccactggagcgctccttgtataagaaggcaaaattcttcagagagaagattgggagtctagaatgaactttgatgctgcatcggctcagtccctatgaaactaacattcttactagagaaagtggcctatggcacagtcataatcctttaccatctacatcttccccttgggatttctttctcagtatgtgcaaagatttctgatcagtgtccactcccatatggcatcttcatcttctcctctctacccccaaacactcacatttatctctagattgatttattcatgaaatgacccattctaaatttagaaataatgacatatgcccaacatttatttgcacgcgttttcccacaacctttctctataatcttatggtatcacattcttcaagaccaggaattgaccttgcattgggccataaaatacgttgaacaactgcagtttcatcgatatgcacactagaattggtctgcattcaataaactgattaaagaaattaaaaagccaattacttattaaatatttataaaatactttttttcaactttaatcttcaggatagcagttaagagcaagacccagactgaatgagtttgaatcctagctctgccaatttactaactactgaagcttaggcaagttttttttttttaacctctcatgcctcagtttttatgtcaatgaagtcggggggaataatattaactcctattgcagagttactgtgaagatgaaataacataattcatattgtcatgccacatattgcttaataaacattagccatttttgtattgtatgtggtgccctgcacattatagtctattgctctccttttttgctttttttttttttttttttgagatggagtcttgttctgttacctaggctggagtgtagtgacacgatctcggcgcactgcaacctccacctctcagattcaagtgattctcctgtctcagcttcccgagtagctgggattacagatgcccaccaccacaccaagctaatttttgtatttttagtagagactgcgtttcatcatgttggccagaccggtctcgaactcctgacctcaagtgatccgcctgcctcggcctcccaaagtgctgggattacaggtgtgagtcaccatgcctggcctattcctctccttttattaaccataatagtagcaagaacagtagctggtaacatttattgagcaattaccacgtgacagaaactaggctaaatgctttacattgtatcatcttatttaattcccacaaaaccctataagttatattattttccacattttactgataaggaaagttaagaataatttacccagggacattgattagtcaaggttctccagagaaatagaagcaacaatatacatatgtatgtatgtatgtatatgtgtgtgtgtgtgtgtgtgtatatatgtatgtctatgtgtgtgtgaatatataaaattaagtattatctcatgcagttggagactaagaagtcccatgacctgctatctgcaagctagagagccaggaaaattggtagtgtgatttcagtcccagtctgaaggcctgagaaccaggggagttgatgatgtaaatcccagtgcaagtgcaggagaagactgacatcccagctcaagcaggcctgcagggaaaaaaggaacatgcctttttgttctgtttaggacctcaactgacaggatgatgcccgcccacattggggagggcaatctactgaatccactgaaccaaatgctaatcttgtctgcaaaacaccctcacagacacacccagaaatagtggtttacctgggcaccccatagtccagtcaacttgacacatagaattaaccattacagacctgcagtcagtgcactcagtgtcagtaggcatacttgtttgttccgcatcgcttctcttctcttctctctctctctctctctctctctctcacacacacacacacacacacacacacacacacacacacacgtaccacatttactcatttactcatccatttgtttggtcaactagtcattaaacaaatatttgctaccatatactatgtgcctcctgcagaaagggttggagacattcgaagagaaaggtaaacaaaaaatggtccctgctatcaagaagtttccaatctattgcaagacacactcatgtccatataactaaaatgaattatatgatagaagtgcttcaggtataaaccatatactgttagaatgctgaggaagccattaattctaacctgggagatgaggaagtaaacatataaacactaacagcattgatctgggagagaagtggggtaagagcattgccgagagaaggagcagcatgaagaagccacgcacaagagttatattggatggaatagtgcaggacaggcaggtagttttggtgggcttagcaggtagagtttgggagtgcagggtcataaggttgggaaggtaggtttgatatgtccctcatgcttttgtgtatataaaataaagtaaatcctgcattgtaggggaaccccacttggttatccacgtatttgggccaagcaaaaatgggcaagtctagggagagagtgaaaaaatgagattgttctggatatacactaggcacttaattgatattggaaggccagagttggtttgagaccaggctacctgagccacttttctgatgagattaacatcgatttttacctctcgggaattctgcacaccacgggaactaccccctgagttctgattgctctgtgcaagctctgatcaacccctagtttagcatggactgttcacaactaaatcaaaatccagagttagagagctaggatgcctggagccaccacttatattggattggcaaaatgccaaataagtaagtatagcatgtcacccgtaaaattattcctttcttccccaccaagaatagaactcactaagttgacagcacactgtgtcaatatattatagaaaaacctaataggaagaaaagaatggcagttttcactgcatgccccctaaaggtatatttcttaataatttccaagtccactgaaaactgaattccgaaaattagttttatcttactacccaccctattttatcccaaatttaagccttgcctgtacttctttgatacttaatatttttttctttgaggtggagtttcactctgtcacccaggctggagtacagtggcgtgatctctgctcactgcagcctccctcctgcctcagcctccctaggagctgggactacaggcatgcgccaccacacctgactaatttttgtatttctagtagagacgggttttcaccatgttggccaggctggcctcgaacttatgacctcaagtgatccagccaacttggcctcccaaagtgctgggattacaggcatgagtcactgtgcccagcccataattaaatattaatcaaccactggttaattaataattatcaataattaaatatcactcaatgatttattatctattaatcaatattgcttctttaaaaatttgtcaaaaacaatagcctaagacttaaagacaagacatgtcatttctgagattctgtagtcacctataccaaatgtcaccctccctaatgtttttgtgaaagtaaagatttgtatttttttatggtactaattgaagcagtagttcatttgtggctgccaatgagttgactgtaaaaaaaaaccaaaatctcattttaacattgtcgagagaggaaatcctttgtgtttggccttggattgataaaaacgagtctggaatactatatacggtaagtgaatattaaaactagagttatgaaatgttgctttagtgttctcagtcttggagactcaaagtatcttatcagaaaggatacattgttttaattgttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcatcttgattaataagaataacagttgaaaaaacaaaagaattaagagttgaattatagtaatcttttatcagatgcagtagaagcataaatcatcctgaaatataacttggttgataagttgagaaggttaggaagaggaaggccaattggatcattttgtccagtcttcagctaatgcataattgtttcctgcactatattctcaaatgttaaccatattaatatttttgagtctttttgaaaaatgtggaacactttgctcaggagccatgctagtattctctgtatcattattccaatgttagtatatgggctgctgaagcaaaaacatacttttgagtttttaatttctgcctatcagttcagttcataaagctaataattatgatatcatgtaattataatatgatcatccaatatatgttactgtgactctataattctttaaataattcattaaatgatccctgccttatgaaatgagtgacaattctcaaaagaaggcatacaaatggccaacaggtatatgaaaaaatgctcaacatcactaatcaccagggaaatgcaaatcaagaccacatgatatatcgtcttaccccaattagaatggctattattcaaaagacaaaaaataacagattctggtgagaatgtgaagaaagggaactcttttacagtgttgatgaaaatgtaacagtaaattagtaacagtatgaagattctcaacaaactgtaaatagaactaccttaccatctggcaatcccactactggttatccatcccaaagctaagaaatcagtatatcaaaagggtacctgcacttgcatgcttatcacagcactgtttaaaacagcaaagatgtgaaatcaacctaagtgtatatcaacagatgaatggataaagaatatgtggtatctgtacacaatgaaacactgcaagaatgaaaccatgtcattcacagcaacatggatggaactggaggtcattatgttaagtgaaataaccctggcacagaaagacaaaaatcgcatgttcttactcttgtgggagctaaaaaaattgataataaacatagaatagaatgatagatactagtggctgggaaaggtgtgtgggtagagggggagataaagagagggtggttaatgggtacaaacatccagttagatagaaggactacgttatatcatttgacagcagaatagagtgactgtagttaacaacgatgtgttgtatatttcaaagtaccaagaagaaagggcttgaattgttcccaatacatagacaaatgacaaatactcaaagtaatggatgcctcaaataccctgacttgatcattatgcattctatgccagtaaaatatcacattacctcataaatatgtaaaatattatatatcaataataaataaatactatgcctccaagttgaaacctcagcctatgggcatttcctttccctaactgtttgcatccttcctttttttttttttttttttttttttttttttttttgagagggagcctcattctgtcacccaggctgtgagtgcagtggcgtgatcttggctcactgcaacctccgcctcccgggttcaaactattctcctgcctcagcctcccgagtagctgggactacaggtgtacaccaccaggcccagataatttttgtatttttttagtagagacgaggcttcaccacattggtcaggctggtctcgagctcctgacctcaagtgatccactcgccttggcctcccaaagtgctaggattacattcgtgagccttgtattctccttttgttcttgacctctagccattctttttatttactggttttgctattttattaattatgtttttataattaatactaagagaaataaccttggttaactgaaagtttaagtattagaaaatcctatttatacaatattgcatattaaattggcaagcacctgttttcctctgattaatgttaatttataccactttttatttgattataaaagtatatgtgttgagttttttggtatttaaaaagccatactttaccacatggagttaacatctgttagcattctgatgtatttccttgtggtcatatatgagtatatatgagggtttatccatcattttaacgcaattactttgtgcctagaaatgttacagattttaactagtttaatccttatagcaatcccttcaatcccttaaggtaggtaccattattatacccatttcaatgatgaagaaactgaggcacacattcatacagctagtagatgagggagccaggattgaaactcaagaagttggctccagagtctgtgtttttaagcatcgcactgtaattttacttaatttatatattttatagagaggaagtaattctgtatgatctccattcttctgccatattctttcattgccattttctgatcatttcctttcttttccattctccacgggttaataaaaagatccacgctcacaaatactttaaagtatttgagtagatgttgtcatgtgtgtctccagttggctgttgtctttttgaacaaaatttcctggaaggtgttggtcctgtgtttttgtcatacatcgataatagattaagaagaagtatcttattttctggactggctctaactttattatccgcatgtggtctagttatttggacacagtttcacaatgctttggagttgccaagaaaaagggataagttaaagcagtttatctaaatgagtgggatcgtggcttttaggaacggctctagaaaaatgataaaggctacagatttcgtcttctgcatctttccaaatctctggtctacttaacttgccttggtgacagccattctattcgatttaattgagattaaatgtgataacatactcctaagcgactcataaaccataaataaaaaatagtactattatgaatattaattactcctcagacaccaggtatattcattcatattttcttctccctgactccccctctgaattcccatgtcttacccattaaaacctattttcagaaaatgatatactcatttaacccaagtgataggtaaagtttaatgtgtacttctcctgggttatttgcattttattagtgtgaaaatccataagcctgaggtggtagaacatcggccataagctctgagctgtgaggaaggaactttgaggggccaaggggagcattctcacacctttcaaaccatatcacatcagtgcccacttccagaaaggtcaggcctgttagacacaggtattcataaagagactgatctacctgcctgaatggagccagccccggaagtcatcagtctcttggatgcccatgtggaatatcaatatacgcttaaaagctttgcttgcaggtataaagaaaataccaacttggtttaagggatatttaagaaataggacggtgagactaaggatggattgtttctttacattgtactttttaaaattacaaaggtactctatacacatcaagaaaaatttggaaagcccacagtacaaacaagaaaagaaaaagtatccataatcctatgactcagagataatcactatcagaaatttggtttatatactttctgtatttctcttgtggttgcgtgtgtgtgtgtgtgtgtgtatcaaggttctatcttttatttttttatttttttgttttttgagacagagtgcaatctcagctcactgcaacctcccccgtcctgggttctagcgattctcatgactcagcctcccgagtagctgggattacaggaatacgccaccacgcttggctaattttttgtatttttagtagagacggggtttcactatgttggccaggctggtctcgaacttgtggcctcaagtaatccacccactgaggcctcccaaagtgttgagattacaggcatgagccaccacgcccggcctctctcttttcttttaaaccatgcgcagataaaaacatgctacagttttatgagctgcttttttcccttaaaactatctttccaatattttcgtgtgtttaaatattcttcttcagagtaatttttctaatgactggctaatactctcttctgtggctgtaccaaatttaccaacacaattctaaattgctcaatataaagattatttcacaatctttattatatcgagcattatggctaatatcctttttatacctttacaaatatctcagattctttctacaggataaatgcctaaaggtggaattgtcatgttaaagaatgtttacattcgtaagccttttcaagtgtattgccaaacttacctctagaaaattgcaccagaaattgggtgtgccatccaaaccgtatttgagctaggcatggtgtggctcatgcctataatcccaattctttgggaaactgaggcaggaggatcacttgagcccaagaggtcaaggctgcagtgatccataatccacccccccccgcactccaatctgtgtgacagagcaagaccctgaccctaaatttaaaaaaaaaaaaaaaatcaccatatttgaagcaggacatctctgaagtcacgtatttgctactataaaagcagcttccccccaccaatgaataaaaatatgttttaaatattcctctaaggtcatattaaatgaatttgaattgatacttttttttagacaggcctgagttgatacatgtttagtaatgtgctttcaggttactataaataataatagggtggctcctaaagcttagaaattacaaagaaaagaaaaataaggaggaactactaattgcacccgccagcgtaaacatgcttactgtctctgtttatcttattctctctctctctctgtctcgcacgtgtgtgcactctctctctctctctctctcacacacacacacacacacacacacacacacacacactcccctttggaaattatttggaaattacattaccagctgtctgttgtttatcagaagacagaggcagccttttactaaaaaaaagaattcactgtttcttcctggtggcccaatctctacatgttaaagaaattttttcttttatcttagatctaagagaaaatgagaagagaaaagcattgtgaaatatgacccttctccgctgatagacactaacttgtccttacttctagttttaatacactgctactcctaattgacttctacaacttaaaccaagaaaaaggagaaattctaatagtgtgacttcaaatatgtatataatttacaataaaattatcatttaaattatttaaattatatactaatttatagttatatatgtataattggtaggtatattgtcagtctcttcatatgtctgtgattaagaaagtactaaagtattcattggttggcatagtagtctgaaaattgtccttttcttttgaagagtttaaagatttgttgggcgtggtggctcacacctgtaatcccatcactttgggaggctgaggtgggcagatcacttgaggtcaggagttcaagaccagcctggccaacctggtgaaacccccatctgtactaaaaatacaaaaattagctgggcgtggtggcactcgcctgtaatcccagctgcttaggaggctgaggcaggagaatggcttgaaccctggaggtggaggttgcagtgagctgagatcatgccactgcagtccagcctgggtgatagagagagactctgtctcaaaaaaagaatttaaagatttttcctgaccattatttcaattctctggtcttctgttctaaattctacttttctcaccaagaaagatcactatatatttgggtaaagggagaaatcattctataacagtaaaaagaatccatggttttcttaatattttacaagttccagaggtcccttaaaagaatattttccaagccaggttctttaaaacattaatgttatattaggttttgataactgtcccttgaaaaaaatagtactgattaataagattggaaaaacactaggtttcaaagataagcaagtttatttcttgttagaattcttggaatttttattatacactgagactctaagaggataaggagtctatagttctccagttttaggtgactgtggaagcctttttcaggcacaccagttaatttcacactaaactttatgccatggatcacagtgaatctttgccttaatgtggtatttgccagatgctttaatgacaaaaaatttctgctaaaggttgtagaaacgtgatccaattaaaaagaaaatgagtatttatgaggcaaaagggtcaagtccctctctttactgaagttcccagccccactcccacccaggagccctcttgtgctgtggagtttcctaactggagataagcttagaaagtatctataccagtagtttccaaactctgaggtgtggctcattagcaaatcctaaaatcagtttaatgacttacaaccaacaatttttgactggtatggaatggaatggaatggaacagattagaaaatatcagagtgcattacctaagcaaggttaagtgttgttttggcggtggttaatttgttagatatgtgtgtacatgcgtgtgtgtgtgtgtgtgtgtgtgtgtgtgcgcgcgcgcacgcacgcgcgcacgccagatcacagtgtaaaacgtttttcttctgtgggttgcagtcgaaatagtttgagaaacattgaatcattcgagccctttccttattttacagataatgaaataggtgcagaacgatcaaatgacataaccaaggtcacaaagatagttataatactgggactggaacccagtttctggacatccaagccacacatcacactgccttacccgttaagaagaaatgcccaggccaataactgtctagtctatctgctattgccaacgattattctctcgtatattcctcttcgtttggccatcctaagttgatttacataacctaaatttttctctcaacacctctgggctaaaaactgccttatcaaaatggtatcgatagcggttaagagtaaaagctgtaaaatgaaactgactgggttcaaatattgactcagacactttatgcttttttctttctctttattcttcatctttaaaatagggataatagtaacatatttggtcaattgtaagacacacttttccacccacgtttcaacagttctgaaatcagaatgcaccatacgaccaatgggatattgaattcggtgaaatatggctgtattatttcatagggttacagtgaagatcaaacagttaatatttgtaaaacccttagagtagtgcctggaacatagtaagtgctattcaagtgtttgctattagctttagcattagtatcattattactatcagcttgatagtataacttaatgcatgcctgttagagtcaaactagtcatgaaagtttcattcattctcttgcatttaatggtcagtataagtagttcctctcctttctgaagatgatttccaaggatctaatctgaaagtccagtgttttgcacattagaacggctcaatagttgtttgtataactaacgagtgataaataatcaaaaagatagaccttaatctctaaaatgtcaggatagtattagtcttgttgacagttatattctacagtacctaatgtggtatgtggtacttggtagatgttcagtaaatatttacagaatgaattatgtcttatacccaaaagaagaagaggtaaattcactcttgacattgataatacacagaggcatgagatttagcatagtggctatcacatagtagacactcaataaataatgtgaccttttctgttgcttctcagcaaagactaatagcattcataactttatatggtcgtttttatcaaagtcgactgtaccatgtaatacattaagggaaaaggctgacttcaaaattacagcatgatcacaactatattacaaaataaaataaaaataacagaaatgtacacataaaggaaaaatggaaaataaaaagataccaaaagacaaacagttattgcatcatttctttctttttacttttacaaattttctggtaatagcatgtactacctttgtaatggaaaaaaaacaataaaggtaacattttatactccagcttttaaccagtgacctcttgcagtggcaatgggactctgaaagacaaatttcctttttactatttattctgaatttaaaagctgtttcattgagtgaccttctcagattatgagacactgtaaaaagaaataactgatccattatttcttgcaggctttacaatcttaactgccttaatcatatccctggttaagtctttttctctcttgtcaaagtgactcaagcttttacagtttctccttgatacatagggcctagcagtttgtttctatcttgagagttgccaagctttcatcctggacattccccactacacatacacacttaattttaaaaaataggggaaacctttaagcacatctaataattgctgacatttcacttaacagtgctccaacctatgctaccagtgtcctcaggggacagacaatttgaaatatgagtggggcaataatttaaagcttcagattggcttaaataagccatcatgaggccgggtgcggtggctcacgccagtaatcccagcactttgggaggccgaggcgggcagatcacctgaggtcaggagttcaagaccagcctgaccaacatggagaaaccctgtctctactaaaaatacaaaattagctgggcgtggtggcatgcatctgtaatcccagctactcgagaggctgaggcaggagaatcacttgaacccaggaggcagaggttgcagtgagccgagattgcgccattgcactccagcctgggcaacaagagtgaaactgcatctcaaaaaaataaaaacatcaaaataagccatcatgataaaagtcagaaagaattttgcaggtccaatgtgagatgatttgcaggctaaaattctctttcaagtaaaatctcagggtgaaatgatttgagccagtttcttcagcagtcacatgttgtcccaagtgttaggaatttgggacaaatgccatgtgacctaccagtgatgctgataatgcccctataaattcaaagacagcctttccaatgcccataaaaagcagctacagcagtaataattatattctcttcttaaaatgtgttgtcatggcccttttctcctttagctcaaatgtatactccccaataagctctcagatttatttgctttacagtatcattagcaaccagattttgcatcgttggccctatatatcccatcaatttgaacacatgaggaaacagaacgtttttgtttctgctatgggaatttctgtgctggggctggcttacaatggctcaagagagccaattgtaaaatatacaggaattgtgagctagttattaagcctacctttggtagcttgaaatcaggcatagtgggaagatttactccatggaaattggcaaatactacaaattggggcactttgttttttttttttttttttttttgtgcatagatggtttcccagaaatgactaatttatctatgttatttggatcactcaagtccctgtaggcaaagaatcttcataaacttagcaggaaggatgctcaggatccaaatatttatgtgcgttgcagagtgaccactcatcctggtttgtctgggactttcccggatttagcactggaattcccattttccaggaaatctctgtagtcccaggcaaaccaagatagttgctcaccctagccttaggtaaaatccctagaagtagagccctatttagatagatggggcttcttgtagaagtaatttgttcaggtgaaagggagtgagggaagcaggataaagtaagaaggatgctggtcaaggagttaagtgggaaggaagagactcacttcagcttgatcccacagggagctctggagaacaaattgtccctactttgagataaggggcctgggctttttgtttgtttgttttgagatggagtcttgttctgtcacccaaactggagtgcaatggcgtgatcttggctcactgcaacctccgcctcccaggttcaagctattctcctgcctcagcctcccgagtagctgggactaccgcgcctggatttttttttttttttttttttttgtatttttactagagacggggtttcactaggttggccaggctggtctcgaactcctgatctcctgatccgcctgcctcggtctccaaaagtgctgggattacaggcgtgagccaccgcgcccagccagggctgggcttttattttcccgtgtgaattagtcattggctgtggatttctggggagtaggagatagcaaagcagttcccatttggccaagggaggatttctggtgaaaggaccaatgaggccttagcaaccaacactcacaacaactgcggctgggtgaaccagctcagtaaaagggatctgagtggaacaacaatagtattaacctctcctagactttatgaagctgctatcataccccatgcataatctggctttagagctgaatgggcgcatttagctggatcactaaccaccactccttcgtcacggacttacatggaaattagcccggtggcatggaagagatgagacaaatgtctgtttctttcttatttcatcttcctcattgtgacagattcttctgggcctcatgaggagctagggccaagagaccagcaccagagttctgaatcagttttataacatgggcactattttggtggaatgctggctctgaagggtgtatttttacactacccagaaaatgaaggcatttgtgaatttggcctggggtagcattttgtcatctgtccaaaatacaaagctttgcacaacagaaatagtgggatcacatccctgtgggcaagaatcattactttcgtttttccatttggatgttttccattttcagaacacaaccagtttgggattacaaagtactttctggtgagaactttgaagtgaggacaaaaggcattttgttctttagtagacttacataaactgttcctggtttaaaaaccattctagatttttaaatagactttcagatatctgcagtaaaaatcatcttgatttcaggcgactgcaggtactgctctgttatgtgctatgtctccttaaggctgtaagggacagggataggcttaggtgataaggaacattttcaggatacagagaggcatgaagaataacatgggccgggcgcggtggctcacacctataatcccagcactttgggaggctgaggcgggcggatcacgaggtcaggagttggagaccaacctggccaacatggtgaaaccctgtctctactaaagacacaaaaaattagccaggcatggtggcgcacacctgtaatcccagctactcaggaggctgaggcaggagaatcgcttgaacccaggagacggaggttgcagtgagccaagatcacaccattgcacaccagcctaggcaacagggcgagactccatctcaaaaaaaaaaaaaaagaaagaaagaaaagaataacatggaacaacagacaccacgaaacatgtttgcttctttctgtatatgcatttgctgccatagacttcagactattacagtatcatatcttctctcttctctccacctaacaccttctacttatagtttctactttcttatgacttccattttcttcctttgttatccgactttttaaacttccccacccatctgtcatctctgtttatctctgtgtattacattcaagctctccaagacaaagcatctgattggattagttatttattatccatctaagggtaatgccatctcacaggccacaggccagactgtaaactaggctttcttgacctgggcactattggcatttggggccagataattagtggaatgctggctctgaaaagtgtatttttacactactcagaaaatgaaggcatttgtgagtttggcctggggtagcattttgtcatctgtcctagaatacaaagctttgcgcaacagaaatggtgggatcacacctctgtgggcaaaaattattgggggctgtcctgtgcattatctctggcctctactcactacatgccagtagcactcccctcccttagctgtgacaaccaaaaatgtctccagacattgtctgtctgatgtcccctgttgggtgaaattgcccctagttgagaatcactcctttataccaatgcctgcacaatttgtggtaatgaaagtcatgtggaacactaaatacagtgacctatgcctgaggaattatttgaagttgcttttctgcatccttagggaccctttagtctctcgatgaaagggagtgtcctcagcagacaatcttcaggaattgcatcagctgcctcacccaagatcataccccttacaggggcagctcttcctgatcagtgtaggggaataatgacctggccattttggcccaactcaggagaacattaacattctagctcaagagctcccatggggttgaatgagactgtcactgggtctgcattcaccttgacttctccctatttctattcctgtttctttcacttcccttccacagttgtctatcctgctctctaatcattgccttagagttggcttcctggaggaagccaatctgtgagggggcaatgaaattgacaggcatttagaagcatctaagaaaaaggtattataataggcccattacagtcactgggtaatttgatttactcttgctttcataatgaggttgattattttgttcaggataagtagtgattattattatttaaggtgtccaacctcatgatctccattaataggtaaggactttggggacagcataaaattacatgaatctcttaccttaaaccttaagctcagcagcatacatgcccatgacaggcaagagttagaacgtaagatggtcagtaacatagatcttgaaaggaaatatgttggagtgtgagcactttaagggcatagggcctgcattacttttttattaaaaataattttgcatctaacacaacatcttgcatattagatgcaggatatgccttgattgaatgaataactgggcacttaaaagattgttcccagtctaataaaatgaaagaacttagcctggtgcttagtctaatgtccagaaagagttaatgaacttcactttatcttcagtcagttaagaattgattcactttgttactcaacaaatgtctgttgaatgaccaatgtaaatcaaactctgatctaggaactggggaaacggcagtaaataaaacaaagtttatttattgtggagcttacattttaacaagagaagatggacaatcaggtcatgataagtttgatttaaaaacaaagaataaagcaggctaaaggggctagaggatgggagaaggggacccttttagtggagtggtcaggaatggtgacatttcagtagagatgtgaggaagtacaccagtcagatattgggggacaaagtgttccaggtggaggaaacagtaaaagtaaaggatccaagatggagcatgcttagagggtttgagaaatattaatagcaaggaagccagtatgactgaagccaaggaagaaagatggtgaatgataggaggtcagtgagtgaccaagggccagacgaggaagggtcttatcaactatggttggctatcgttaaaagcctttggcatatatgctttgtgagaagggaagtcatagaattctgagctaagaagtgacatggtgcctgtagcattgttacttactgtgcctgtagtattcattcattcattcctatatttattaacaaaaacgagtcacctgaaatatgaagataaaaagagaattattgccttgggacatttaaataccaatcacaaaagacagacctataaaaaatgacctcctacagtggtagtaaatagtgggtgcaatgggagtagaatggaagggaggaatccattccacagtgagagaaaggagatgttctatctagttgagtattaacgcatattgtccctgaggctacatgcaaatccaaagtagagggtattccttttgataggaacttagcaaagaatgtttataattgcttggtccctgatctcacctagcaagagtcacaagatgcattcagtgatgaaaaatcagtttctcccttctacttagccattctgataagatgaatatctcgggccgggcgcggtggctcacgcctgtgatcccagcactttgggaggccaaggtgggtggatcacctgaggtcaggagttcaagaccagcctgaccaacatggtgaaaccccgtctctactgaaaaatacaaaagttagctgggcatggtgacaggcacctgtaatcccagctacttgggaggctgaggcaggagaattgcttgaacccaggaggcggaggttgcagtgagccgagatcgcgccattgcgctccagcctgggtgacggagcaagactctgtatccaaaaaaaaaaaaaaagatgaatatctccctttccagtttcgtgtgtagtctccttaccgcccttctgttcagaaaagggatttcttacgtatgtataatgaatataaatataggttttagagagcactaatgttttaatgagatagaaataggcagacgagagagaataattgaaggattagtcaacatgagggcaatttgatagggaaagaaaaagtctgagcaggaaatgtctgtggaaaaaaaaaatcgaagaggaatggaatgaaatgagctcatttatggtgtgagttagggacagaagggatttattctcaggaggtgaaaagtgaaggagttcatgttatagaattcgacctagaccagctatcaagggaaagaaagtaattcaaaagacttggtccaggagatctggagcagatacatctattagaggaagattcagttttgaactgcatcttcagttattcctggaacccaacacaaaagctcatgacaaccttgttatcttcaggcaaaaaaaaaaaaaaaaaaaaaaaaaaggcgggggcagcaaggcttatgtcttaaacaagacagcacataacttcaggtcagagaattccattaacatgaatcacccacaccaatttaaataggaaaaaaaatagtaagcttggttatgtaaaaatttagtttaaaaatcagaaccaacaattgaaattaaacaagaatgttttatttatttctaaaaatatttagctatttattttgaattctgaagcaatactaatatagtatataatgataaaacacagttgattttcatagtaaacatcagcatcagaatgccaagaggaagatttgtctccgttcatgttttattactctgagaaccgcgtaacattttttaaagagtcagaaaatggctagaaaaagaggaagaaagattatttccttaactagttccctggtcccatgctttggtggttaacagtcagtttaactctagaaccatggaaagtctctgtcactttcctggttaccctgggattcctcacattggcagtaagttcgtgaatgagataaatatcctgataactagctacattaatgatgaaaataattataaacgtaggagttggaatttttaaaaagtatcgagcgctctgtgctcttaacacagaggaagcattttgcatagattaacccgtttaatcctcacaccaacctttaaaataaggactgttattgtctccatttcacagaagagaaaactgagactagaacaatttactaacatattcaagttcatacttgtaactattatggattatcagccttagaaaaggggttccagacaccagtgaatagcaacccacacgtctcaactgcacagaccaaagaggatgataatccccattaatctttgcatgttagtagaggcagtggctagtaacaaatgggagagactttggctggaggatattttttattctttaatctttatgatactgtttcccctctccccttctctctctactcctctctctgtcagctgtatccacaataatgccacaatataactactatacaagaatataaagcttctgttctcatgcttatgggtctacaggtcaactgtaattcgggtgatctggataaaacttgactggaaagctctacttcatactgaagcatgcctgggttcgcctctaggctgtgagttcagtttagatggtttctaaatgtgttgggttgtgagccccagactaaaggatcagaagcaacctggggcatgttctcatggcagattgccagtgtgacaagcctctgttcacatcatatctgctaaagcaagtcacatggtcaagcaagccaaggtcaaggagctaggaagcacactgcgctcaccatgaggccatggctaaggtatacatgtttagttctttcacaactgagtgaaaaatgggccccaaattcaatctctcctatactctttttgcgttaattgctagttctttctcactcttctcgctttctaatggatgtacatcccatctatgatcatttggtttttaatatctgagttgctccctactgtctcaggtttcaaattttactttccttgaaatttccctggtgcctaatacaatacctttcacacagagagcgttcagcaaatggtgtggactgcctgtcgtcttttaaaagtacatctgcagagacagtaaaggcacctggcgatattgcattgacttgttagtaacctgacttaacccagatggcccaaagactgtaaccaccattacctggaggaaagttccctggtaatgcagtcagccaattatgttcgaatttactcgaaaattccttgagcataaattattcatggctctatttatgtaggtatctatcttcctatatctgaccttaggaagcttgattgctttcttactcttctaataatcaccgtgatgtttttgaagttttctataagtcggttagaagcagcttttttttctttttttttttcatgagtaatgccgcccaactttggctattagactttgtgtgactgtgcagccatcagcactggatattagatatagttttatctctgcaactcagtcaccttgccaagaattttagtatgaactcttgacttcccagatcaaatgtgagcctgatactctaaatgacttggcaatctactgacaaatcccatggtgtggtattctgttcaccatgtgcaatggtctcagagctcagcattatctgtctgacagctcatataatatttacaggttgttattcgttaggaattttagttagccataaagattttcacagctatggcagacattagaggtctcattcatcactcttgtgaccttcctctctggaatgtagcccatctgtctctgctgttgaaatctttatggaaagtctgcccatctttgaaagtttagtaagtgatcttaaagttttcattgaatctttacttttgatatacgatatagacatataaagcactatccttattttaatttaacgttttgaaaagtgttaaatttaacttggcctttcatttaaatgacagaaaacttactcttgctacaggaactatatgcgtcacatcaaaagaaaatagaaatcatacagaaaaaaattggaatgggaaaaattacacatatatacatatatattcaacactaataactacatgaaagcttaaatactgtattataatcctgattatgactttaggaaatgaaaacgatagaaatacattttgcatataatttaacgttataaagaaaccctaagcaaattcagtaatgaagtgaactgaataggctgggttacagagcacaagagagggatgaccaacaatcagatgttgcccctttccatttctgttttcctctttttatacacaacttctcaaatgcttgcttcccctccgtctactccctccttcagcctctgatcactagtgtgaaattgcccttttgaggtcaccagtgatcgtgggatcaaatacatcttcttcttctacacccttagtctgtcaggctcaagaattgcttatacttcaccagctaggctgttcttgtgtttcatcccactttattctagcttctgtattatttttctttgacagcagttctactgccaccgccatttgggggcatttgccagggtacattcccttttgttttcctccactgtactcatctttttttttttttgtacttttatagctttcttggggtataattatatgcaaaaatatgcatatttaatatatgtaatttggtaagtttggacatatgtatacacccaagatactattgccacagtcaaactaaagataacgaacatattcattacctacaaaagttttgtgtccctttgcttttgtgtgtgtctgtgcatggcaagaacacaacatgagatggaccctcttttttttttttttttttttttttttttttgagatggaatcttgctctgtcgccaggctggagtgcagtggcacgatctcagctgactgcaacctccacctcccaggttcaagcgattctcctgcctcagcctcccgagtagctgggactataggtgcgcgccacctcgcccagctaatttttgtatttttagtagagatggggtttcaccacatcggccaggatggtctcgatctcttgacctcgtgatctgctcaccttggcctcccaaagtgctgggattacaggggtgagccaccgcgcccggccgaggtggaccctcttaatccccttaagttttaagtgcactacacagtattgttaactataggcactatgttgtacagcagatctctagaacttactcatcttgcataagtgaaactttatactcattgaataacaatttctcgtttcccctgccctgtcttctggcaaccacttttctatttactgcttctatgaggttgactatttcagacacttcataaaagtggagtcatacagcatttatccttctatgactggcttatttcactgagcatgtctgcaaggcccatccacattgtcaccaatggtaggaaccttcttttttttaatgctgaatggtattccattgtatgaaaatgtggtgtatacatgcagttctctttgtacgatcttccttccttaaagagtccagccattctcatagcatctgctatgattctagtacttatggtcttgtcctttcacttgcatttcagtgaaaagaaccaaacttatgctgatgcaaatacctgtacacaaatgttgataccagctttattcatgattgccaaatgctaatcagtctatgggcctctgattttcactgcataaaatatagactaatctgtttatcattcatgctgatgaatggtggataaatggtctagctaagaatgaaagatctgttgtatagatgtcattggtctaggaagacagagatgtagaaagaagtaccataagcccaggcagttagatactattcaaaggcatttctctctgccatactttatactacatgtggcacattaacagtagttaggagtggattcaaggctgcagataaatgctgcccaggtgagagagaaagaattggttccacaattaaccatcattcagacaacacatcatagctatgtgattacaaacattatttgtgtggtgattaacattttacaaagcaatttcatattgatttcctcattttatcctgacaacattttggtgagggagatatcattattcccattggaatataaggaaaataaggcttaggcaggaaaaagactagcttaagatcatgaagtgataggggagtcaggactcaaatccagttcttctgaatctgtactctggacattttctgctatatccagctccctctcaagatgctggattgggctttgaaatagaaagccaacatcctgagtgcctttctaaactctgagttttacagtctatcaggggaagaggagagtgtgagaggaatgttcccaaataatctactgtatcaagcagtatatctaacttgctttgagaattatgccaactaaatactattgacctgcagaaaattgatttttctctttacacttatatcaataaagagaggcttctgctgccataagtgtaatttatgtaaaatgtttttaaaacattcatagcctttaatcaagtaaatatacttctaggaattttgctttaaaaaagtaactaaaatatgtgcaaagatttatctacaaagatgttcactgtggccttacttagaacagtgaaaaactggagacaacttatatgttcccaaagagggaatttattcaataaatcatggtacatccataagtgggaattttttagcaatgaaaaatctgttgtaaccctacaagcccactcttaagcattcatcttagagaaatgaaaacttatgcttatgcaaacacctgtacacaaatgttgataccagctttattcatgattgccaaatgctaaaagcaacctaatgtctttgaacaggtgaatggataactaagctgtagtacacccatataatggcatactacttagcaatgaaaagaaacaaatcgttgatacagcaatatggattatgcattatgctgagtgaaataaaccagtatcaaaaggttacatactgtatttatatgacattctggaaaagacaaaacaagtctagtagatcctccctaatgccttttgttcaaccccagaggtgagttttctattttacctccagtgattgctgtatcggttatttatctaaactgtccccacttttttgacccacctatgttatcaaactccaaatccaccaagtatgagaaaagtagagagatgaatgaaggtatttgtgttggaattccagaaagtgctcttttggcatgtcttaaaataacattagcattctttttaattttctggttaggcccctatgttgattaaaatatgacttaacaccagggtgcatcacttggaacattctgttcatcatgcatttaaaaacggctgaaataacaacttcccctaaataatgtggcctgtgcttgtgattttcaaaactaccttgggcacaatattgaatcctgtcacctcaaggaaggaaaagcatttgaagatagaattgctaccctttcttgctcttaataacatactgtgtctgtaacacaaaaggaaattcagaggttggttttgcaataaataaatgcatgtgtagtttgctatctaaattcagtggacaataccccatgatgctggtgccgtatgataatggttgatttgtacattcaagaatctgaatcacaaagctgccctggaattacacgtagtggttataagcacatctgtataagaaaataccaaaggacaacccggtgtcatatagaaactatttgccgataaatttgcttttgatgggctactaaaaatggacacatcaggcataaaagatgtgtgtgtctattacgtaggctagctttatgaagaatgacaagcttccactggtacactgagataagaaacagctgttgttggcatcagtactgctacaagaaatgaaaaaattctgtggcacacttgtgagcactgccacatatttgatcaacttttgaatagatggaagaccagaatcatctggcagccccaaatgaaattgtcgacaacccttaagaatctcttgagaaggagcactgaacccaattccgtagaactatcatccaattgtgtgttatttctaaagcaagtagttccagtgtgtgtgtatgtgattatgatggggcagggaaggaatgaggggaggctgttgttattttcctttttttttttttttttattgtgtcaaggacatttttgagcataaaattgtaaggtttcaaacaatgactgcaaagcagttgcttaggtgaatttataaactgtgaatcaaaggggaaaaacatctttcagaaaaaaaatacactgaatctcaccattggacctatttgatggctacacataagacaaaaagcttttttaaggaaaataaatgaacacttaagaactgcaattacaaaagcttgaaatttcatattgatctagaatttataatatttttaaaattctttaaaaatattttcagctatttagttcaagcatattctgataacttctctgacatttaattgaaaattttccccttttaatgtaaacataaaaagtcaactctagataccctacgtaggtcttcccattagctcagccaggcaacgccaattttcctctgtctctcgctgcttagaggttgtttctttcaggccgaaagcccctaagccaggccaggcagccagcagccctctccagcacacttctttctgagagacgcctaagaatagtgtaggaaatccaaagtgattcttctgctatcagaggatggtctagcatcctccaaattagaaagaatttctggaccactagaatgataaaaaaaaaaaaaaactagaaaggtataataagagaaattgtgaggcctcagcccatagatacctttaaggaaagaatagccattcttttctcagtttaggtattcacaggcttggcattcacagccagtgagggctggaccaagagctctctggagttctcttcttccttttatgatgctggtattttaagaagaaggtacactgagcagccaggagctataatttctggctctccaccatgtttcctgctatagagggctagctttttaatatttccataacaacagactctgaccagataggtcaggaagtctagcccatggtttgtttgtttgtttgtttgtttttcagttggagttttgctcttgtcgcccaggctggagtgcagtggtgcgatttcagctcactgcatcctttgcctcctgggttcaagtgattttcctgcctcagtctcccgagtagctgggattacaggcacctgccaccatgcccggctttttttttttttttttttttggtatttttagtagagatagcgtttcctcatgttggccaggctggtcttgaactcctgaactcagatgatctgcctgcctcagcctcccaaagtgttgggattacaggcgtgagccaccacgcctggccttagcccatgtttttaaatcagatcttatttactctgtgaacttatttggacaggagagctgcatcctacagaagaaaaaaggacaagagaagagttgggaagagaatgagaaaggcaaagatggaaagggaagcagggaaggcaggaggaagggaaaagaaaggaatagagaaagaaggacagaaagaaatggaaagtcagagactacttcaaaacagcagctaaatgtcttttttctctgtattaaaaatttccgtctgccaaaatgaaaaagcataattaccggccaaatacaaatccatttcctatatcgtttaaatgacatatctccaaggtacaaaacagcatgtctggttaaaggttgggtgatttgatccctctattactctatataaaacaaagaagctggagtttcattacgcttaaattgtctggcagtgggtgaagttaacttttattagaagctgttctttcatattatacagtgtagtcgaggatatattagctttgacgttttcttacatctcaatacactgcggagtgaatttactgtgagactaatttaaaagggagtttttcataggaggaaataatggtcagcatcagctgtgcttcaaattattagcagaatgaaaattcaggggaaaaagtatagacacataaagttgctagatattaataagaatgcgtcttttatttctgtttctgataatattctgtgtttcttaaagctccagtgtcttaaaactatattcaggaggaagattatattgttgaggaaatgttatagtgcctcctcaacaagattattttgtcttaaagaaagaaaaaaaaccatcagatcaaacagtatataaaatatatttgtagaggttcagctttagggaagaaatcctacaacttaagcctgaaaaaaaaaaaaacaatgcaaagatcattcatttgaccaatacacagtgaagtcataataaaacaaattcctagtatgtgaaatgaaatttcacgtataggattcatcactcataacaaaagtcttattacgctctgatatcagtagacattccctcacttttggtcaccttttctaataagatcacactggtcagctgacattttgaggcaccaaattaagcatctatttggtaagtgaatttggattctctttaaaccaataaagataaaaacaaccatatcagagtgataagcatattactttagcttcaataacttagaatgtaaatatatcacagagggatatttcagctactgaaataataaaatccagtcagtcaaatagtaaaaaatattgagaaccagcaacaggaagtattataaaaaaaagcactcaagggagacacatacaagaaaccccgtcagtctactcattcagtttcttatctgttctataggtttagcagtggaaatgtttgtgggttttttttttcttcgcatttatctttgtgcctgaatgagttcagtttcgcttagattaggacagaaatttcagaacagcaggttaatccatcctgtcttcatgggcagctgagcaaacagaccaatatcagtgtaaaattgtaattctggagattaatgttgtctttcctgtttgcgatgaatttgacctccttgcctttctttttttcctcccttcttttcagcgtctgtccagggtccctgggagagagccatctcgccaaacaaagtgccctactatatcaagtaagttggaagtatcacatttttaaaagagcatttattgtgactaacctgtatattcacaagtgagtttatttttaaaatgcgacattagcctggcctacaatacctgtgtcttttttttcctgaggaagcttggataaaaaacttattctaaaattaccattgtaaatttgctgatgcaatggggaacgacttttaagaaaagtttatttaatgcaggatatatggtgtgttttgtgacagagggggcggatttttcacaatagaaccaaaagctccagataattttattgatagtgggagtcaatctttgcgagaacaatttcttttatttaggggttttctcacatttcttcttccgtcaaagatagaagatttccgcagttatatgtacacaactgttttgggtgaatgaatactacatgtttccaaaaggcagaaagcagcagtcctcgactcgtagggcttagttgttcattcttgatacataacactcagtatttgtcacctaacaacagaaagatactgttttctggaaacatttgtgccagtcaaaagaatacgagtgcttggaagcaccttctgtagtattttgcatgaaatataaatgacaatacattgggtcaacgtggaagagagaggagagaggatattgagtgattacgataccttcacagtctctcatccattgtgcactagagtctaacttaaatttaactttgaattggaaacctcaacaacaattacaatttactgggttcataaaatagtcctcgataccaaccgaagtctttgaacttgcttctgccatgagtctgactaaaaatattagatgttttcccatttttttccgcctgccatcttttatcgaatctgtttttattctttcactgtccatcaattcttcttaattcggttctaaagcaataacagcagtcctagatcttcattactacagtcctcaagaaatttgattttatgcctctattttgttaactcagaaaaatgggagtgaaggtagtcttttgactctttcaggagaaatacatactttaggaaacggtttaccatttgtcttattacatttttccagatgaggtatctcttaacttgaaaattcttttttagtatgtttgattctgctttttagttttcatattttatgaatttaattttattattgttatatttaattcattagtcactcaaaactgtacattttaaatacctatttaaatcacatgctttattaaataatatattgctgtagacatgcactgtatattaccttacatccactgtatattttatggaacaattttcttcaaactctagacagtgatttcctacatcagtgtctttgtcctcacaaatttttatttccgactaagatgtttgagacctgctacttcttcaaccaattcataaagctctcacttttatccaattcctttatgagctgaaataaagactctttttctcctttcatagatgaggttttaggatcactggagaattcaagacacctttaagctattattctccaaatgactacttgtttggggctcactagaggtctcacatggattgctagggtctccccggtcccattgtcctttccctatatattcatcttctccctgatgttacttctactacaagagatcccagtacattgctgtgagggaatggaaatgaactccgtccaaaaaataataaagagacaaattccagaaaagctgtaattcccttctgtgtattagtctcttgctgtttctcagtggaattagagagcagctacatatcctatttgtccaatgctccttcatgtacctaaagaccatggtgatggtattgataagggcacagatctatgaataagaaaacttcaattttagtcctccagtctagtcttagaggctctgtcattaggcgactgtatggctttaggcaagtcacttaacctataaaaatcttggtttctttctttttttttttttttttttttttttttgagatggagtttcactctgttgcccaggctggagtgcagtggcccgatctcggctcactgcaacccctgcctcccgggttcaagcaattctttcgtcttagctcccgagtagctgagactacaggcacctgccaccatgcttggctaatttttgtatttttagtagagacgaggtttcaccatattggtcaggctcgtctcgaactcctgacctcaggtgatccacccgcctcggcctcccaaagtgctgggattacaggcttgagccaccatgcccagccaaaccttggtttctaatttataaaataaagagttggactagatgatatctaagatcctttttagctctaagacgtaatgagcatgactcattcagttgtcctgtccaaacttaaaaaccgaagatctcagcttttgttcgataatatctttatttttaaaattcattattttaatgaacataatgtaaattcttactttaaaaaacaggaattttatttttccactgtttaattagctttagatatgccctatcaacccactccaatttcaccacacacctctttaaagagctcaaatcttggtatataatttaggattattatgcttcctggctcatgataagagagagagaacaataggcaggaaaatttgccaaaaggtgagtatggagaccttaaaagcctctgaaataatcagttccttgaaatgaggaaattacgtaatttctcaaaaatatctctgaaaccttatggagagcaattctctctacaattataatctctttgaaattagggatggtataatttctcaaatatgagtgtaaaatgttaaactgtaatatagggaaaacatacatgtttataaaatgaacattgtcagtaagcagatgattaatggcacttgtgtcttattagccattactattatctaaaatgttctatggaaaccaaattaatttgatgtacaaggttcggtggactttatgcacagcttaatgccgttcataatctgagatgccgtcttggtctaaaaagaacaaaaatacgtttacagtgacagtgcttcaaccagtcctcatttttcctcttttttatcttgtttgtcttgacttccagtcaagagtttttaccacagatgcccagctgcaaaaccaggtgtcttctctggctatgtttttaatgctttgtaactttttcttttcaatgctgggataaagggatcgcccacataacaagaggtttctataccagtggcacagttcctgttggttgttgaattgtgcactcattcttgagattttaagtcattaacatcttttgctctagtttgcaaatcaggcagtgtttatgcctgcatcctgacatcagcttttcatatgaggctaagaaccttgattttgatacttcaaactacgtgtttgtctagtttatttgtccacagcatacatcattgttacagttttcatattccctctcccttggggctcccttattcctgccagcatctctttcaggttatttgattacagctttcattgccactgaaaaaataatcaccaacaatgttcaacctgttacaactgccttttctactctctgccattttgtagttttttggcctactgtcaaactcatgaaaatttcaatataatagcctttaaccagctgctgcattctgttaggatttctttcacctttttatgttgcatgctcccatatgggtaaaccaaacagagccaagagctgggactctcttgctttcttaatgagttagaaaattgttcttctgtattctggactgtcaaaagaatttaggaatcccaaacatgcatgcaggatgttccagtatagatgtcataataaaagcataagaaatatcacactgggtcagaccaacagggcaactagcccggaactctgtcccagatgaagataccaatggttgttttgtcaggtaacctagtacattttaccttaaaaattcggatacatcatgaccacttcttaataatgcattgtaaatcaactggcagtgagtttatccaatggtgtcaaacttttcctattccccacttcagctttgtcttaataataatatgttccataaatgtaccgacttctatataaatataggcattttaatttctcttgaatctgcatcctttaacctcaaggaatggccttaattaaattctttgaaattcagtaaaaacatttatatttatccagagtcgactttagcctcacattcccctactaatgcttttcattttcatcttcccagtctgagaaattctaatcctttttagtcttttagtctgtccttgacggaaagataagctttccccttgattatcttagttgtttttccctggatcttttccagctctgttatatcttctttgggatgtcgtgactagggtggcccaaatattggttatgaaatttgttagcattgtctctagtttccactcactcatgaagaaagtaaatgttatttgctgtctcccattggtgcagaaatggagagatcaattgaggtcataacctcttctgcatatattagttctagccgaaggttggttttctgctacttttctgtaataccagcaaaagtgtttgaccttatatttctgccagctgtcccttaggaaggatttgatttttagacaagctggtcctttcctccttcaaagacgctgtggttgctaaatattgggaagaattcactaatgaaactcaggagtaaacctgctgactccatcagcagtaatgcatttcatcaggttccctttcgaaatatctctgaagcccttcacagaagagtgaaagatggggttcttgggaacttgctaactgctcagctttttttacatgcaatgctcaagaagcaactcatgtccaaaggagtgtttatcttttcctgctggtaattttgaatgttgtatatacattgctgtatatgttgcctgatgaccttgatcgacccttctcttcactctcaatctcaggcatgtttccacaaccatttattgcatctgagttttgctcacaactttctgctgcttcctgcttagcaaaatgcgatataaaaccttattggatgaagttaacagttgcttcagtcaacatttcttgttactgttgctgtttgtgctgacaaaattgctgatttgggttctgactgtcctgtcttcttatggcctaccattcctatagctctatttgtacgagtatttgactctctgcctggaactgtggccatctgtctagatttaccttttggtatatgtggctctctgtatcctgttggtctacattctggtttgaactcacggatcttggtctggtttttagtaccagtgttcccctaactccagtagcatctgaatcttgacaccaccttcccctgccccctactgtattgcctctattactactttcatggcaattttttcggattccaaatatgtcccatgcttaaagcatatcttgctctcattcttgttctagcccctgttggtaccaggcattgctccaattcaagttttggttggttgatttcttccttcataatattgattgctatttcagtacctgtatttatatacagagggagcagtgcctaactacatcttagccttaacagcaatcaacgtgttaaatatccctgtgttggctggtttgcagtagacacgtcttctgacaatgagatgggctcttattataaagaaactggagtatgatatcaacatagaaaacatttcctcaggccgggtgcggtggctcacgcctgtaatcccagcactttgggaggctgaggcaggcagatcacgaggtcaggagatggagaccatcctggctaacatggtgaaaccccgtctctactaaaaatacaaaaaattagctgggcgtggtggcgggcgcctgtagtcccagctacttgggaggctgaggcaggagaatggcgtaaacccgggaagcggagcatgcagtggacgagatcgcgccactgcactccagcctgggtgacagagcaagactctgcctcaaaaaaaaaaaaaaaaaaaaatttcctcatttcttattccagacacctcactcttctaagaatgatacaagtcttctgacattgggtttgaaaatcagttgaattttgtcataatctttcatacaatgtgaacacatcatgtagtatataattttgtgctatttctggtaagatccttcttatgtatatttttcttcaaaatataccttttagcagctaagacaacattaaataggggaaattttaaataggctaggcatcgcaagacttgaattctagttccagctttactgtcacctagctattaatacttgaccaatgggaaattgcttattttctgtgggcctcagtttctccctctgtcatttaaggaagcagaatgacatgatatcataggtcatttccagtactaacattttctgattttgtgaatgttgacttcgaaatagaaattgtttgtgatcattttccagagaagtgaaaatgaatcttcatattgcccttgaggattcttattgcaccatcaatcttatcgggatagaaaggacaaataatattaaatgtttcacttaactatttagcactattgatgataagaagtggatgcaacagagaatcagctgtctaatttgatctgtcagtctttgaggatgctggtgaatgattcggggtaattaaatttttgaaatcactgccaaaagcctgatgctctgacttttcaaaaggctttagtacacaaagataacccagaggtcaatcttctctgctgtgttttctcctctgccatttgatggtttcaaaggtcacgttacctgagtctcagtaagctctggaaccacaatgaaggaatagttggtaatacattattgatgatataatcatgaaaacaattcaggttaagatattaactgaaagagagtgaaaggggtgccatagtgttgtgcagagtgctgagtctggttttggttttatagatcttgttgggagatgtagatgttgatatcatctgtgtctcataggttcatgaaaaaaaccctcacatccttttttgtagtttcataagctgatttgtatcaccttgactgaaataacagactccaggaggatagctgttgttatctctttttctagcatagtgcctcacagataacaggtacttggtaaatattggaatgaattcatgaacatatgtcagtaattctatgtgcttttcagtttgctgactcatttcaccttcaaaacaatcttgtagtatttgtgtgtcaatttagatttaccactcaaatccatctctcatgccctctagacatgaactttagtgttaggaagcatgccgagtgtttgatagagtttctcatagctcctacagtttggtgcttaagggacagtccttggcatggatgtatgaatggtacataccaaaacatgagttctagattccgttctatcttaatctaacaatatgataaggagtataacttagctcaacctcaatgagaaggttgaactagataatgcctgggaccactctcagctctagctttgtttcagtagaactagagtctgtttttcctaaatatcattcatgaggcttcttctggttttctagtggtcaatagagctttaaattgatcaactactgtttttcactgagcattgtggacaggacctactttttgggccaggatatagtagccactgagtcttaacagaatgtcatcaatgatacatttttattttacagaaaaatgttgtaacattctatatggcatatgtcatgtggaaaggtggcaacatatatacatacacctatacatgtggcagctaaaatttaatgtgtgtatggggaaaataatcctgtattataatacacatggtatagcattccctgcctcattcgtggcacttttggaaatgtgagaatgagcatagaacatattcaagttggtttatccaaaagaagaggagtaaattatttcagctatttccccattttctttttctaactttcttaaacatgcactttcttacataatcacgtgttagaaaaaaaccagtagtcacatcaaataaatctgcatttgaaacaactgtatcatatcccaactctgttcgtttgagccatttgcttaacgtgacacccattctactttatgacacataaggaatattgcttaagaaatgttaattggctttccttttctcctctgaaactggattgaagtcttattgacctctattagatactgagtgttcaggtttttaggaaaacactcatagagatatagccccagtgtgagctgcatttttagaatattttctagaacccaaatatgtccctaatcaaagttagtttattttcattcttagcgttcccacgtaatttggggtatgtgtgaattcccaaacattcccgggcctctcctaggcttctctaattgcttcttattctgttcccctgggaagcagcatcctgttcccttcacaaaggtcagcagcaacagcccaggcaatgttttaaaataacttaataaccctgaactgcctctctcttctttgggataatttccttagagcattagtcctttgaacactgacctggttgcagaaaatgcccctttctcagtgggaaaactccaaatcccattcagtcttcccctccttccttccaggggatagggtgggggagtagggggtagggagagggtattaaatactttcttcaggaaaaatgttaacacggtaaaacactctctctctctctctctctctctctctctctctctctgtgtatgtattcttttttaaagaaatagactgtgagtgcattgtataaatcagtgctgtcacgttgcaaattttttaaaccgttgtacaagatagaaaaacagtatctctggatattgactctggaaagcttctaagagcaggtcctagatgagacttagctcactgtcggcattcggcaaatgatcacgttttctgtgataccattaactcctggggggatgaaactgaaaagcctcgctgctcttcctgaaactctcaactgcttttttctgtttttctttctcagcttatccacatccatcttggtccccaaagccattgcatgtcagatggtcagtgcaatgtgtaatttttaacttgcttctttgttgctttagaaggaatcgttttgttgttttctttccttttggtcactatttcttgttcatgagttttctgtaaacagtgtgtctcatagataagtccatgtaatctgctagacaggaagaaaagcaaagtttaatgtgtgcctactatgtgctaaatgacaaagtgtttcatctgtatcttcccatttaatccttgtaacactccacttattatccaataaagaaaaaaacggctatcagtcgggcgtggtggctcatgcctgtaatcccagcactttggcaggccaaggtgggtggatcacttgagctcagcagttcaagaccagcctgggcaacatggcgaaaccccatctctaccaaagatacaaaacagtagctgaatgtagtggcatgcacctgtggtcccagctactcaggaggctggggcaggggaatcccttgaaccagggaggcggaggttgcagtgagccgagatcacaccactgcactccagcctgggtgacagagtgagaccccatctcaaaataaataaataaataaaagttaaaaaaaaaaaaaaggaagaaacagctgagattcaaaaaagttggaggcttatccaagtcattctaataaaggggaggggggagaattgatacttaaaatcatcatgataagaaggatagacattggagattcagaagggcagaatgctgggtgaggggtggataatgagacattacttaatgggtacaaggtgcactactttggtgatggatacactaaaagcccaggttcaccactatgcaatacatccctgtaacaaaactgcacttgtacctcagaaatttatacgaataaaaataaataaatcaaataaaataatcatcatcatctcagctattgcttctagctgtttcaactttctaatgtttttgattgaaaactggccatttgtataaccaaatgtggccaatccaccactgtgaggctgccatcttgggcatcaccaaaactactctagtagtccttccctgcactgttaggtggattttccttggcgtatcttcgcaatcaagttgcagagacctaagttactctttgctgctttgggcaataaaggggaacaaaaaacaaaatgaaacaaaaacttggccagccctgatgtaagcactcttctacctccctgcaggctgagaaaacaaagtatttcttttttttttttttaatttttaaaatgtttgattctggtctaaatcaattaaaatgagatctccccccttcttttttctttttttcttctaaaaaaaaaaaacacaccaaaaaaccgagatacatgtgcagaacgtgcaggtttgttacataggtatatgtatgccatggtggtctgctgcacctaatgacccatcgtctaagttccctcccttcaacccccaaaccccaacaggccctggtgtgcattgtttccctctctgtgtccatgtgttcttaatgttcaactctcacttgtgagtgagaacatgcagcgtttggttttctgttcctgtgttagtttgctgaggatgatggcttccagtttcatgtccctgcaaaggacgtgatctcattcctttttatggctgcgtagtattccatggtttatatgtaccacattttctttatccagtctatcattgatgggcatttgggttggttccatgtctttgctattgtaaatagtgctgcaataaacatacatatgcatgtgtctttatagtagaatgatttatattcctttgggtgtatacccagtaatgggatggctgggccaaatggtatttctggttctagatccttgaggaattgccatactgttttccacaatggttgaactaatttacattcccatcaacagttcaaaagcgttcccatttctccacagcctagccagcatctgttgtttcctgactttttaataatcaccattctgactggtgtgagatggtatctcattgtggttttcatttgcatttctctgatgatcagtgatgttgagctttttttcatatgtttgttggccatgtaaatgtcttcttttgagaagtgtctgttcatatcctttgcccactttttgatagggttgtttgtctttttcttgtgaatatgtttaagttccttgtaaattctggatattagacctttgtcagatgggtagattgaaaaaatgttttcccattctgtaggttgcctattcactttgatgatagtttcttttgctgtgcagaagctctttagtttaattagattccatttctcaattttgtcttttgttgcagttgcttttggcgtttttgtcatgaagtctttgcccatgcctatgtcttaaatggtattgcctaggtttccttctagggtttttaggatttggggttttacatttaagtctttaatccatcttgagttaatttttgtgtaagctgtaagggaggggtccagtttctgttttctgcatatggctagagagttttcccagcaccgtttactgaataggagatcctttccccattgcttgtttttgtcaggtttatcaaagatcagatgtttgtagatgtgtggtattatttctgaggtctttcatggataggaagaatcaatatcgtgaaaatggttatactgcccaaagtaatttatagattcaatgctattcccatcaaactaccatgaccttcttcacagaattaaaaaaaaaactgttttaaatttcatgtggaatcaaagaagaccccgtatagccaagacaattctaagcaaaaagaacaaagctagaggcatcacaccacctgaattcaaactatactacaaggctacagtaaccaaaacagcatggtactggtaccaaaacagacatatagaccaatggagcagaaaagcaaaggatttctaagtcatattccaccacctccatcagggcttccctaagatagagagtatggccaagaccatacttaataaatgtcatggaatgtgtttctcttcataccctcaattgtaagtctttctgaaaggtagcgcgtggtcaatttagatggacaagaagtgctctgcaggagcctttgcaacatttgtgcatgtccttgattttgacaccaccccccgccccccattccagaacagatcgtctcatccttcccttaagccagaggcctatggttctagctttactaggcaaatatatatggtctgtggctataagtcacaatttctcccaagccttgagctgggggaatactgagtctgcccatgtattacatgcagaacatttcatcttattgcagaatgatactttattcttattgcagaatgatattcattattgcagagtgatattctttagtctttattttttatcattataactacatggtgcaaaagaagtatttctcatactttttctcataatgactcaaaattacaaaagcaatctgggcaattaatatgtttttgaagataaataatggcttatgttttctgaagattaagaaaaatctctgtctgaatatagctgggcacagtgtctcaagcgtgtaatcccagcactttggggggtcaaagcagaaggaacacttaagcccaggagttcgaagccagcctgagcaacaaaatgatacctggtctctacaaaaaaaaaaaaaaaaaaatccttggcatggtggcatgtgcttgtggtcccaggcacacaggatgctgaggcaggaggattgcttgagcccagggggccgaaagttgaggctatagtgaaccgtgtttgtgccactgcactccagcttgggcaacacagcaagactctgtctctaggaataaaaaaaaaagaagaaagaaaagaaaaatctctatccgaaaaatgtaggcaccctgtgttaatatgtaaatacaagtgctttatcaaataaaggctagattaattgttttttctcgctcttacttatatcaatactacaagaacttttctgccaaaaaaaaaaatcaaataatagaaaagaatgaatcctagatagagcaggaggggctgagcaggcacagcaaaagttcaaggtggaaatatctttatgcatccaattaaaagtaatttgtgtacattttactcatatatctatatgtacacatacatacatacacagacacacacacatatatatatatatatatatggagagagagagagagagagagagagagaggacaacgaagaggaaactaaagagaataaagggtattaacagcaggtctgtgacttattccctgggggatgtgaagggaataaatgaccttaatagaccacttcataaacatgttaatgacctcccagaccttcttgtttatcttgttaatagtggttaactagaggaaagatacctgcaaatccctatctataaaatgattttagtagggtatacctggcctggctagatagcttattgtaaataaacctggaatgtttggatttatgagtcgtggctggctggagaatagggcatagctacatgaacgtttttctatttttgtaattgacagattataaaatggaaaacttttgagactgaaatgatttcctttcaatgtttctgtgtaaatttttaaaaacgtatctgttaatatgaaaccaaagcacatcataatgggaaataacatggatgttttggaaacgcatgtgtgattatttcaggttccccagggaaataatgttctatctgtgcccagcacttccctataattctttcagtcattaataaagattggtactagataagaatctgagatttgtgtgagtctgatgtgagatccaaatgttatacttacacaatttgtgtttattttagtttaaaaattatctttgccatgagcaagaggggaaaaaaaggaggatgagcgggcctacatatttttccttaacatcttgtcccaagttttaggaaatcacaagtctaagaaaaggccagggtcaggactaggaagtgatataacagttatacatgtctacctttaaaattatataagtaataattaatttttaaccttattttaagcagatcctagaaatagcaagagcctctataacgtcccagctaagaccccaagttttctttcttgtttaactcttgaaatattttgttaattttcagatcccttgtctcctcagttcagctgtaaactctctgacaacgcttgtgccttatgcatctttgcatcatccctagcatgtattatatatctcacatgtaaaaataataataaatacttgatcatttgttttgattttgatgattaagcactggaagctgagctatgatcccaataggtatgcttatttaaagaaaaatagatggcagtccaggcgtggtggctcacacctgtaatcctagcactttgggaggctgaggtgggcaaatcacctgaggtcaggagttcaagaccagcctgtccaagatggtgaaccccgtctctactaaaaatacaaaaattagtctggtgtggtggcagatgcctgtaatccccactactcaggaggctgaggcaggagaatcacttgaaccctggaggcagaggttgcagtgagccgagatcgcaccattgcacttcagccagggcgacagagttgagactccatctccaaagaaaaaaaaaatcacacacaaaaaaatagatggcacggcacagcagcttatgcctgcagtcccaacactttgggaagccgaagcaggaagatcacttgagtccaggagtttgagaccaggctgagcaatatagcaagactccatctagaaataaataaataaataaataatttttaaaaaatagacaataacagataaagaagttccatgttatttttttaaattctagatagccccactggtgttacagtttattaaattacatttggaagcgattttttagcagtccatttattttgtatatttcagtttgttgagagcagatggggttgagtgttgatggggttgattgcctggctagattatgctataaactataaatctttgaaagttactgttttgaagaaagcatctttaagtgaatatattccttcagtagctcctattaccaaaactgttgtgagaatatcttaggaaaacaccttaaaatcctcttctatcaaaactcccaagctttcttcaggagccagcattgttcagtgaatgcatgtaagcctatgtcttaatagagggatccctaacctctggaccatggactggaacagcaggaggtgagtggtgagcaagtgaacattactgcctgagctctgcctcctgtcagatcagtcgtggcattagattatcgtaggtgcacaagccctattgtgaactatgtatgcgagggatctaggttgtgacctctttatgagaaactaatgcctgatgatctgaggtggaacggtttcatctcgaaaccatacccccgcccctgcctcccagtctgtggaaaaattgtcttccagaaaactcatgcctggtgccaaaaaggctggggaccactgtcttaatagatcttgaaaaaagttggagtaaggtaagtggtaaatcctaagacatacattgaggcagagctgcagtggtatccagtagggaagaaaagacttcaagtttagaattcagttatactcaaccagtttttgcctttctctgttaaatattagatatcattaccagacacatacaaaagattttaattgcatgaatgcccgatgttgatacaagagagccgatttttttttcacacatagttttttggggtttttttggtagggagaaacatcatctcatgatatcgttttaaaggtgctttattatcaaggaccttagagctttttctctcactcatatttcatatactcttagtcctcaagccatttctttttactgaaagcactatagagtagcaaaaggcatcattatattgctcagcctcattcatcatcaacaaaattgccaattatattccaagtccttgaatgtattgtttaaaaagatgtataaggtgaaaggaagcagttcaatgttgaggtggaagatgaaacatactgactggtagattcagagcatactaatcttgttttcacttgtgaactggaaaaaattaacatggagggatggagaaaacatgttcaaactacaaagtcattttttctgagaagttatctgactgtaactgtaactgtaactataactcagggtatatcagagggctcaaatgtggaacacttctttaaaattaaaacctaaaagtcctgatgtgtaatagaacgtgtaaaaatagcagcctctgaaggatctgagatgagcagaggaacactgaataatataatctgacagtatgggccatacccttacagtagttgccgtggcctggaaactatagaattaattcagtaaaacatcagaaaaaaagcaacataaatataaaatattttaaattaaaaagactgaataagaacagaaaaaaatcccctagcaaatcaatattgcttggggaagcatgaatcccagaccagcaatattttaatccaaataacttttagttccatcgtgaacacctttatcaccaagttttataaagagtggagtgaagaaaaaaagtacttgaggttgttggaaacacttctcaaagttggtggctttattcagagattcatgcttgactgtaccaacttctgtttaatttatacgtagtactttgtcaatttaggaatttggtttacttgtcctttcctaaatatgtgtattacaaaacaaaaaatagagaaatgataaaataattacaaagatgattaagcaatagtgttggctatagtgaacagattattgccattttatagagtaataatatacctaaggaaatctgtgggaaatttaatttgggatataaaacacagaagtcaggcggagatgaaataataaaccaataggaaattaaatttaggcatgagagtccaaagatgtaaattctatagatgttataaaataatatgtatgcccttacataatttcattactctctgaacttcatttctcagtgaaatatggggaaatgatactgaacagtgcagcagctcttccgcttatgaaccaaccagaagatatataaacaactcttaagggttatacattataaagatataatttagtctggatttttttttaaatttgaaaactaattttatataaaccctaattgggcaattctccattctttgacttgaatattatagtaaatatgttttcccaatttccaagtttcatgtattattttcaaagaaaaaagacaaacttttaaatgtccagctacctgggacttcctctgattatcttttaaggtagttcaaatatatacaatttcaaacaacaacaacaacagcaaaaaatattttgccagacaatatgtcttgtttgtttttaatgttcacaatgtaaagtacacttattgccaaacctcactttcaatggtgttacaaattagccaagtataactagtttgtaaatactaataagaaggttgctgaaattcagccctgaatatttcttttctgcaactccaaagaggaaaatttttgaaatgcaaaccttgacctttatcaaagcctaggtgaagtttgttggaggtgtttggttttttgctggtgctttgttataatgcagtttgaaagtagactagattggcaagacataattggctgctgtgtggagaatgcatttggtggaacacgtgagttaggggtgaggaaatatgaagagccagagtggaagcagggagaccagatagtagtgtgggaagcactggtgttagataagatctagataaaggtagcagtggagatcacaagaggtggttggaatcagggaatatggtttagaaacaatcacaggtcttgctgatgcattggaggtcaggagggacagaaagagggcaatccaggtgtctcctcggctttcagcaggaacaggtacttaaagaggaacaaatttggtagggaaaatcaagttttagtgttccattgcagtacatggtaaccatggctaataataatgtctcatatatttcaaaattgctaaaagaatagatttttaatgttctcaccgcaaaaaataaatgatatgttggtgaggtaatggatacgttaattagcttgatcaactctttctacaatatataccaagatcaaaacatcacatcgtatcccataaatatacaaactattatttgtcaattacaaataaatgaaataaataattttttaaagagatgtcttaaagggtggcttgaagagcttctgtgctccaataatacctgcccattagccatactttgcttccagcaacaacaggaaaacatttaatctaaacaaaaaaaaattgcttgtcaactagatagctactcttccgtgtagaaaccctagagctgcctgggtttagacatgtttaagtttgaggtacttattgggtatctagctgtgcagttcaaaatttggatctgaagctaggggaagacgtcaggacaagagctttaacttttgtaatcatcaatatatacatccttcttagagtcatggggtgggatgccatcatattgggatgagggaggaaaccctgggacttcacaatatcgagctagtttctgttttgcaaaaggcaaatgtattaatgaattcattacattaattaagcaaactatatttattgggggctattgtaccagctattgtaaattttatattttatattatatatatatatatataaaatgctcacaaaataaaggaactaagtcataaatatgcatatgatttacataaaggagctaaaataaggatctctgtttctgtttcaattctttattaaagatctatctaagactataaagacatatataacaaggtacaggaggtaaagagtatattcttaggcatctaaaaatttttcctatgcttttgaaatctgtgtgatttactttcttgaattggcctgtaatataggagtacaatatcattgcagagattaattagtgtgtttgtgaactgttctcaaatgctaaaatgaaagcataaaactataaaatggcatcattattccttaaagaagcatagtttccaagggtgtctctgatcattgtcacagcataaatgaccaatttcacccataattagccaagttagtaagaagttattttttactgggtatattttgtttaacctcagttatatttgtaaaagtagaaactgctacttgttactgctttcagaatttctcacaaatgctaaaatgctttttaattctaatgcacttaaatggtttgattctccttacctaagaaaaacatttatctaaagatatactcttgactgattcattcattgattcatttgtcaatagatgtttatttatcagaatatgtgcaccagatacattgctagatgtaaagggtacatttggtgagcaacatgcatgatacctccaaagtatagccagggaatagataatggaaatgacactaagaatgaatacatattaacacaaaaagagagagagagtcatgtgtcaaggcaatttagcaggagggaacttgtcaatacaagggattaaaaggacagcatgactagggctggaggaggtgaggagaaaactcaaaaagtcctctggctgatgcaaatgaattggatgaggagcctatgaatacaaacgtttgaaggttactgatgaaagccaggtgagagaagatgggatttggaccaagatgatgatagtttggatatggtgagaaaggcatagatttgagagatttttaggaggtaaaaatccttaagatttgaggatagatatcataggaggaagggcgcaaagagaaagcaaaacatgtcaaggaatcacacctagatttctgggcaatgcacagttggtaattctttacagtgagttagggaactctaaagaaagatcagatttagggtggcaatttgattgtaaatgtttggatttcaaatgattggtgacatccaaaaagcactgtaaatagacagatagtgtgcacctaaagaaagaaggaggcgcatctgggttggagtcactaatttacatattacttgtatatagctagtaactgaaaccatgagtgtgaatgagattctgatgctaaattctggaaggtcactttttaaagtgttttgctttttgaagtacaggtgcaatactaaaaataaaaaagactaatttttaaaaattaaattaaaatgaaaagcctggaaagataaacaccaaagttatgatactagttgtagtatgggagagggggcatcagagaggatcggaatttcatcttgaatggtgtattttatttcaaaagaagctttgagcaaagataaaatgttaattctgagcattagaaggaacacatttgtttttttgtactgtggatctttttgtatttcctagaactcttaatctaaatcaaatattgcaaaatatatcactgtaaacaactggttggtcactagctttttaaatactttgtagcaacttggttgcttgtcagaggtcttctttgagtgaagtctttaatttatagttctttatgcttgatcagcataattgcaccaaactgttacttaatctgaaaaatagctgtttcctagagccctacttaatactgaaaacctactgtgtttgtattgcaattgcatttttttttttacttttccccctgcttttcagtttgtataatttctgttaccctatattcaagttcactggttctttccttgtctttgttgaatctacagatgagcccatctaaggtatttttcttttctgttactgcttttaatttctagcatttccatttgattcacttatagtttccagctctatactgaaatatactgaaatatagagctggaaactataagagtgaatcaaatctaatcttgcatattgtcttctaatcttacatattttctatctaatcttgcatattgtctttcttttccctcaagagtctttaaaatattaattatggttattttaaatttcctgtctgatagttccaacaactgttacatatctaagtctggttctgattcttgctttgtctccttagactgtgatttttcttgcttaggcatgctttgtatctcaggggtaaaagtcaggcatcttagatagcgtaatagatactgaggtaaataaacctttgacatggtaatttatcttaatctgactgggaattgggctgtgtttgatgttggtagttgctttggttgtcattgttgagttttgttgctgctgtggccaccagagacttcaaattcctctggtaactttgtttcctcattggaagcttgttagtgtagtggttgagtgtcgggcagaggcattctctaatgtttgaattaatacacagttggcctgggtcttggggatgtggtctttacaattatttctttcccttcctccagaggtagagtaacttcaacctcccattcccttcctggagctgcagtggatatccaccagtgttctcagtctatggccccaaggccctttctcctgcataaggctgaaaaacaacaacaacaacaaacaaacaaaaaaaaacaaacaaaaaaagaacaaaacaaaaccacacatagatgagatctggtgttcccttcccctaaaatgcagtggtatttcctcagtgcctgatatggtttggttctgtgtctccacccaaatgtcatgtcaaattgtaatccccacatgttggaggaggggcctgatgggaggtgaatgaatcatgggggcagatttctccgttgctgtacttgtgatagtgagtgagttctcaagagatctagttatttgagagtatgtaggactttccccttcactgtgtctatcctgctgctgtgtgaagatgtgcttgcttcccctttgccttctgccatgattttaagcttcctgagggctccccagccatgcctcctatacagcctgcagaactgtgagtcaattaaacctctttgctttataaactacccagtcacgggtagttctttatagcaatgtgatgtcttttcctctgaagagaagggtataagcagattcatggtgactagctactgtgacccttccccaatcagcaacacagagggtgttggggaggctttctccagattcttcgcatcctccttgtgaaggcaaggtacagttcctgaaggaagaagcttgcaaaaggttgggactccacctatggcagtagcccccaggatcttcacactctcaggctagctcccacatgtcccccaacaatttaatctccctactagtttatatggcatctgctccagggatccaaatgctcaggcactgcttctggctaaaggccaatctctctccagatttcaggttgttctataatgtcatttctctgatggactgatgaaaagtcattaatttatctgtccagcagttttcttgctacaagtatgggagcaacctctttgcagctctccatctccatctccaagttgaaactggaagtctgagcaatacattttagaaattaatatttgtaagttttccgtgtcataacaaaaataataaatgttcactgtggaaaacatagaaaaagattaaaaatatttaagtgcccatcaccacctagacaactgcaatgaacatgttggtaatgtcttcttccagttttttaaaatctgctgataaaatacaaaagatattgtttatataactttgtatcctaccttttcttgagcaatgcaagtttaaacctaaatacgaagatactctaacttcctactttacatttttgacggcagatgtcagctgtcttcccaagtgcagtacccttggcttaatatcaggtagacaaataaggccaccacaaattcacctttcacctcaataacacaggtaatttgatagttctacagaccctataatattacttgactgaagacccagaatacaagtctttcaaggattactctagaaactatataaagtattggtatcatctcccttcatcatatcttgccaaatccaacaggtttggaacttctgtaggaagatttttgtaacatgaaaaatgcgtgttgcaccttccatatccagcaaatacaccatcggttttttgttggctgcaccaatgacataaaatgatttcactgaatagggggtgacccagaatggaaatgtagagcatcgaaaataaaatcaaccgacgcagtctttgcagcaaaccatgtggaaacaaatttaaatatggaacatactctttccaactcatcttcagatgttgctttaaaatttgtgcaggtgaaaaaaaaatctttattttaaggtaactcaatcttttaccattggagagaatagaattatttttgtttcctcttgtatattcccagttgtttaaatgttctctgtttccttgtgtggacacataaatccaaatatatctaatatcaaggtatttaccatatgcagcactttttcctcagatagttattttttgaaatattcaaatagcttacctgtatcatcccccccatccttttttttttttttttttttttttaagacggagtcttcctctgtcaccaggctggagtgcagtggtgcgatctcggctcactgcaacctccacctcccaggttcaagcgattctcctgcctcagcctcccaagtagctgggactacagttgcatgccaccatacccagctaatttttgtatttttagtagagacagggtttcaccaatttggccaggatggtcttgatctcttgacctcatgatccacccacctcagcgtcccaaagtgctgggattacaggcgtgagccatcacacccagcctaccctattttctaaacgaacaattagttgacttttcttcagttcttactcagaaatatctgaccctaggttccaacttttgttttgctctttgcagttagtttttatgtgtactgttagggagatgtgctttttttttaccttcaaatttaaaagagagagttttcaattccttttaagtcaaaatacaactgttctactctaaagctttctttaaaaaaagaaaagtaccaaatcctcatccgtagtaattaattttgacagtgtaggctcagtagtgattcacaaacctgtattttgtgcatcagcattccttattattctaattaaagtggaacattgtgccctcgctaatcattaatgggttttcattttgtaaatgacatttgcagaagttaaaacagcgagttcatgtgaagtccacaggcaacggtgttgaaattagcatcaccatagcaacagtcttccatcattagcattcagggcaacaggaggtgttttgttgtgttttgtttcccaaaaaaagaaaaagaaaaaaacttcaaaggtaaagcctacagaaactctctcagaagatatttatgttccttgtgtgtatgtgtactgtactagacctctaagtctacatagaattttttttaaaaattgcaatgtggatcatctcctttccagatttgtgttttgcctagtatactagctaaatttcatgatctttctccagctgtacacgtctgacctgctgagcagcatttactcattgccaacctgctgctcaccaatagggtttcctacgtggatgaagagagtctgtattcatgaaaatatttggttcaatctaaaagtattatgtgtattcatgagtttttaatttaattcatggaaaatagatttatgctgttagatcctctggtgaactcatttagtcatgttgtagatataggtcaatgattattctcattcatgtttagacggaattaaagaggagtcaaatagagaacaatattatcttaactgagtctctggcagtggtattaccactattactctgtatgtgtgtgtgtgtatgtgtgtgtgtgtgtgtgtgtatgtgtgtgtgtgtgtgtgtttgaattctaatattctgggaaactttaaaagtggcatatctagcacttatgtttttctcagtactaaaatgcataaaagagcaccatattgacctaccagctgcttctaaatcacaccagtagtaggtaattatgaaattcaaatgaagtttaattttcatttattatacaaaaatgtcatagctcaaacccagaagtgttacccccaagcttggatatagacaggtatgtgtgtacattttacttttcaagatgaatcatagcagtcttctccattacatgtaaggactagaagttgtacattccactcaggtacctaaaggcaagcctgtgctagcccacactaacaaagcaaaatgaagcaaaggatctatctggctttcaatcagggatgcatctatgctatcatcagctctgtcacataataaatgagtctatagataacttgaactactcagccaatgggctgtaacccagtgattctgtggtattgaaaggcagcaacccccagaagccacatgtctcagtgtgcactccaggactgtaggcccatagaacttgtatgtatgcacacatgcatatgcattccccacttttctaatggcgatccaatctaggcctaatccacagctagtccagaaaagaacttttttaggttttctgtctgccatcactttgttgagaggcagtacaagccaagcaggtgtctgtatttataatatgcacaatgttaggataactcaaactcataagggaaagattaatggctgactactatgaaaaccgcttctagccttgtgataccagcacctactatcttcctttttctcttatatgatgaaaagatttcaatgttggcttttcattctgatagaatgtgcaagccaaaatctaaataaagtccagtggcaatgatccccttaaacattatatctttcttctcgatatgctgatgttttcccttataaaaatctatgtaagtttcaagatttatatgacagacaaaccacacaaacaggaggtccctcacattcactactagtcacttgctctatcactctgggaatagcggtcttcagattgcatctctactctacctcttgctcttttcaacccctctcctcttttttagaccatacagggcatcagacaaggtttagtttaccactaaactttgggatttggaagatggtgtataaactgatacaggtagtccactcacagatgtagtatataattacagacttgagttttcaggggctcttctccagtttcctgtcaatcaatttccctggctgagacattagcatttgtcagtgaccatgcttactatatacatacacaattgtgtatacacaattgtaaaattaaatacgggctttagaagagattattttttcttaagagtaggttactctataaatgccaaagcatgtgttatgacatagaaattcaaatgactaagaatagctaattgtttagaaacatcttacttgatgtctattgttccaaaatttgatccaatttagagtggtaccaatccatggtgtagaatataaaagctaaaggataacaaaaatcctaggaatctcatgccagtaagaaagttctaccagtcagatgagatgttgagagcatttatgacttggcatcaggaatattataagtaaaattcatgtgagcagtaattgcagctatgaaccatgttatttgttcccacttgtccaactgtaattctttcacttagctcagagtagttctttgtaacattagggcccactcatctgcctttaggtagggttttaaaagatgcctagaaaatagttctgtgctagaaatcagagactcttgacctactgtaaagggagcagtaagcacgtttcctcaggagaatctttctacatactgcagattcccataaaaatctttgtgacaaaattgcctttactgaaaccatcatccattggattaaaaaatagcttaccattagctttttgaaaatagaaaacgttgagccttttcaatgatactttcaatagtttttcacaactatgagtcctcaagctatcagtcttatttttagataccatacttataagatagttatagaatttatagagtatggtttaaaagactattcaattatagagcaatcattcagtttattcccatggcagaagtaaatggaaaccactccagatcaacaagaatctactctcttctgattcagaaaagagatttcctatcttttcatgaataatccatgttcaatgtttaacacctcaggaagattttcttaatagcttcttctggtcataaatccttggtctgtcatcagggacatattgaagagttagttaccaaagttcttaatgtctcccattgtaaaaaaaaaaaaaaaaaaaagtcactttttggattgtttctttcatagagtccatgcttctgtacgcttaatactttagcttttgacttcaagctttaggtaatgcaaatgaagctattacatcaccaaagttaaatttttcttgtaagtatattctcaacattcacaattgagagctgcctcttctttggctggtataaggttttaatttattgtagcactttcaccctagaatggcaaaaaatgttgaaatcaattccatatatcaccaatacaaagtactaagtcaaggccgggtgtggtggctacgcctgtaatgcaagcactttgggaggccaaggcgggcagatcacttgatgtcaggagttcgagaccagcctgaccaacatggtgaaaccccatctctactaaaaatacaaacattagccaggcgttcatagcgagcgcttgtaatcccagctacttgggaggctgaggcaggagaatcgcttggacttgggaggtggaggttgcagtgagccaagatcatgccattgcactctagcctgggtgacagagcgagtctcaacaaacaaacaaacaaaaatattgaattgtacaccttaaatgggcgaatcgtatggtatgtatactaaatgtcaataaagctgttatatgaaaaaaaaatgctaacacacacattctgaaagtatattaaaagcaaacctacggccgggcgcggtggctcacacctgtaatcccagcactttgtgaggccgaggtgggcggatcacaaggtcgggagatcgagatcatcctggctaacacggtgaaacccagtctctactaaaaatacaaaaaattagccaggtgtggtggtggacgcctgtagtcccagatactcgggaggctgaggcaggagaatggcgtgaacccggggctggagcttgcagtgagccgagatcgcgctactgcactacagcctgggcaacagagtgagactccatctcaaaagaaaaaataaaaataaaaaagcaaacctacaatgtctcttacaaacacaggcaactattcaattccgagtttacactactgaaacacacatgaatatgacactaagagaatcacgtggatctgcactcttcaatcaacactacgtctctgagcacaagaattttacatctgatttccatttggggaaatagattcagaatgccataaaccagatacttcttgccttcctttagtggtcatttctgccattatcatttaagggaatggatctccttctcccaaaactgttaccctaagattacaagcttgtcctttaacttatctctgaaagcacacctctataacgggtcatcagtattcagtcagctaattagactgcagaagtacgtttactcaaatgtgaggagataaaattgtgaaatgtaagaggaagaaagaatgtcaaagataatccaacccaaactcttcatcttacagataggaaaatggaagtccaaaaggggaaagtaattttagtaacatggctaaactggtctagaaaaccagatcttctgatacctgatcccatggtctttctaatgccatggatgttcgggtagaggatatattcaggtagataacttatagatagccccatgtgtttgtatagcactttatcgaacactttcacctctattatcacacttgattcttacaatatcccatggaatgtttgagtatcatatatgattattcttattcccacagacttggaaactgaggctttgagatgtctggatctatcttagatcatttgctatggactagaatctgggactaagttgcttttgtctaagctgtgtgtttgttctgttgtgccgtattgttaattcatttctgttggtaaacaacacaaaggaaaaacttctataattatgtttctttttcatcctcaggtcatctatcctactttttatctaagctttggaaaatattatgtgctttccttttttttgtattttcttttcgtagagatggcagcagggggtagtctcaccatgttgcccaggctgacctcgaactccttggctcaagcgatcctcctgccttggcatcccaaagtgctgggattacaggcgtgagccaccacacctggcctattatgtcctttctttagcttgctcgtttaaccatttgtttggcagggggagtcagaactgtgttttacttagtcgattaactgataggacaatttaatatctaccctgcactggcagtaacccccatagccccgctctgtgtctcattctgtgccctgaacaaccttgtcttaaaaacattttaaaagcagcaagtatggggagatttcttatctccatataatacagaagcaagtgtagagtatggctacggaaaacaaccagcaggtgaggctgtgacataacaattttaacccaagcctcactgccacattgaggtatccttgttcaataaatagatcagaaaatatggtgtagtttttccctaacgctgtctaaacagcaacaacaaaaaatcattacccatagtatttcagtaatgtgttgtattgaatgcattgttttcgagggcgttttcaaaaaataagttgattgaatctcttttttttgcttgaagaatgacccacattcagaaagtatacagatgaaacatgttcagctcaatgcaattatcacaaaatgaatacacctatgttcgccatctaggacagtaaataaaacattatcagtagccctaaaccagattacacacacacacacacacacacacacacacacacacacacactaaaccagactacacacacacacacacacacacacacacaccgggttgggggagtggtgagagagagagagagaaagcgaatattatgttaacagttggggagtctaagtgaatggtttatgggtgttcttttaacatttcaattggtttaaaattttcaaaatgaaaagcttgaggagaaacatagaatataaccactacctcagaaatcaccaccctacctcacccacattccctctcccaatcactattcctccctcatcttaaaggtaactgctactctgccttataacactatggttgagttttgcctgtttatttgaactctataaaaatggaattgtacagtatataaccttttgtatctaggactcaacattgtgtttatgagattaactcatgttgttgcatgaatctgtcatacattttcattgcaatttgatatcccatttaaaatgtatactataatttatccattctattgttggggaacattttggttctttccagtttgaagacattatgaataaggcctcctatgaacattctttaatgcgttttttggcacacacgtgtgtacaactgtgtttggtatatactttgcagtaaaattgcctatgttgagggtaggcatatgctgagctttagtagatactcctggttttccaaagtggttgtaccagtttacaccatcattagcagtatatgaaagttctagtagctccacatctcaacaatacttgatacttgttagtctttaaaattttcgccattgcagtgagtgtgtgagtagaatctcattgttattttaatttgcaattgtctgattacttatgaggttgaatatttttacgtgtatttattgaccattttggatatcctgttgtgtgaagtatctattcagtctcttgcctattttttttattgattcatccttctttttcttattgatctgtaggagttttttttacatattctagtttgtagccctttgtaaattgtatgtgttgcaaatatcttctcccattttatagctttccttttaattaaattgtttttttgattgatagttcttaactttaatatagtccaatatgtaaatttttccttagggttaattcttttgtgtcctctttaagaaatctttcctaatacaagataatgaatgtatcctcttttattatcttctagaaacttactattttttaacttttccatttagatatatagtacacctggaattgaccttttgtgtaatatgtgagatagagattgagttttatttttcataatatggatatctagttggcccagtacttgatgctaaacattcatttagaattcatttgatagtatttcctttagagttattgcatctgtgtttattagttatattggtctgccattcttgtcaaggtttggtatgtggattattctggtttcataaaggcaagtagggaagcattgcctcttctagtctctggaagagtttctttaagattggtatttctgccagtgatatgatttggccttggaattttcctagtgggaaaatttataattacagtgtttatttcttaaatagtacagggctattccaattttctatttcttcttttgtcagtgtcagttgacttaaagcacactaagatactctaagattgctatggtcagcctttgctggtctaaaccagaggttgcaaactgaaatgccaacagaggggctagcctgctactgtaactgggcaaggctagcgaagcgtaagttaatgggagctggtagggactatagaatacatgtgccgttatagaatggtggctccggaaagttattgtcatgcaagaataggagcccagcatggacaaatcattccttttaaatgagaagtcagaaggttggattattctgtaaaatatctctgaatatttaaatgttgagtaattcagattaaaaaaaaaaaaactgtgtgggctaatcaaaacatttgtgcatgccaaatttagcccaaagtctgctagtttgcaacttgtactttcaactaatgaaaagcgtaatagcacagatataattccattttcaaataatataattcatttatagttgacatttatttaatttacacttaaatatgaatttgtcatttaatttaccatattaaaaaagtttagattttaagacatccaagtctgcaaataactagaatattttcatttactctcatgtttgtgtacttatttttccttaaatgttattttcatgatatacttagtgtcttgtggacattccaaaaaactgatttgacttaaattgtcctcactccaagctttaaaattgcttagttcatagcctaccttgcctaaagcaaacctggtagtctcatttcaagttactggattttttgtttgtttgtttgtttgcttttgccttgtttcttttcaaggttatatagagtgaaggaatatcagacttcttttaatttttgcagggaattcagattgctgtggattaagatcctatatataagatgcttaggatagaggcatcatgaatgaaaaattattcatatgaacacactttttagagtattatttttattcattcagcaaataatcatagctgccatactaggcaggtagggaccatgaagactactgtccttgtagtctaaagtcttgtagactaataagatatgtataactgttaaatagtacactgaaaatacaaccttaaacaatcaaaatatttgcaaattgtatttagttgacatgattgcataattgtatttatgtgacaattatatttgttattcacatatttagggagtcaatatgtacttaaggtaatctttgagctattttcaggatgaggtattagctcattactattaatactaccatcaccaaatgcattacctacttatctgcatttccaggaaaaattcaggaaattaggatttttaaaataataaaataatagtaaataagactgggcatggtggctcatgcctgtagtcctagcactttgggaggccgaggcgggtagattgcttgatgccaggagttcaagaccagcctggccaacatggctaaaccccatctctactaaaaatataaaaatcagccaggcatggtggcgtgcacctgtaatcccagctactcgggaggctgaggcatgagaattgcttgaacccaggaggcggaggttgcagtgagcagagatcatgccactgcactccagcctgggcgacagagtgagactctgtctcaaataataataataataataataataataataataataaacagaataataacctaagtgactatatttgatatatagttaagtgatgtttttgtagactttactaaactaaaaaataaattagcagttatttaattttctagtttataaagtacctacttacataaagttgcatatattacttcatttaattttaaaagaatatcgtaaaatatgtaggatagatttccattttatagtcaacaatacttattatttcaatacattatgtgattttttttcccccagtatcacagtgttagagcccaggttcaaaccagcattttctaactgtaagtctggaagtctgtctgcttactctatgtaagatgccttatgaagttcatagaggagacagctcagtggattcaggcctggtcttatattttgctgttcatcttgttttaagtgttatgttaagcaaataaaacataactttaaacattctgtttacttttaaaatttgatttagagctaacaaaaattagaatttgtactccatttacaacgaacagaacaaccaaataagcaaaattgtatttgcgttgtcaattacaataaataattataatggtatatcagagtgttaaattttgatttttttttttttgagatggattttattttattttttattttttttttttttgctctgtcacccaggctggagtgcagtggactgcaacctccacctgctgggttcaagtgattctcccgcctcagcctctcgagtggctgggattacaggcacccgccatcatgcccagctaatttttgtatttttatagagatagagtttcaccatgttggccaggttggtctcaaactcctggccttagatgatccacccgcctcgacctcccaacgtgccaggattacagatgtgagccgccacacctagactaaaattttatgttcttatatttctttaaggaaagcaaaaatgttgacagagagggttaatactagttatatatacaaaaaacctaaaaataagattttggattattctattatatgattattcatttattgaaaatcataaactaattgaatgactgagagcagcactaatgtgattactttggtaggaatctgtcctccaaagttgtcagttgtcagttattcttagcattttgaactgaagtctatgtaattaagtcacctgttgtttctgacaaaatgagcaaacacacataaaatctcttggttcgtcttcatgtctctgtggcagagaactgaccacattattcagttcctttgtcctttttagacaaaagccacctctacatggccctataagtcttcaattcaaggactatagccgttatcttaatgggattgtacttggttatctgataaattgtcgggaacatacccacattgcttcctttacctgacataaaatttagtcagctggggctcaacgattgaccagctttatcttgcacgtagtgaagggaaggactttcttactcctggatgtgcctaaatttaagcctttgaaaaagattgaagataccaattggcctacctgccctaagtagatgcttcccacagacttaactggtgaagtgcttgtctaaggtagacagaattttttctttagagaggagcaaacaaaaacccaaaaatactggcgtgttcttttgatgttctatttcccaattgatttccgggttcacactactccacaacatcttactgtcccattgcatcttaaccctctctcctctcccgcccccactttttttttgtctgtttcttctgcttccaccgttgcttctgctctgaagcaatcattttctctcccttcaaccaagggtggaattggcacacagtcaattggcttgggagactgcttactgatctgtcttttttgaacactggaatcttgacactggttatcattttgaggacagcctggtttggatatttatctattaagaggaatccttaattggtgtctttgactggagtatttgaaggagtctttaattgggaggttttaaggcaccagaaaagattcattaggaatgactgacctcatgttatataaatgagaaatatttaccatttgctgtacacgtaattgaagcatgattatacataaaagcatataattaaaaaatgtaaataaatacctaaataaataaatgcctataactagcatggcaaaggattctgatatcagctttcaatctcttttagtagagactggacaaatcagaaaaagaggatttatacctgtcctcctatagattatgctttcttctcccatcatccagttttaattgaatctcctcattgtgctttctttcaatcttgagctgcacaagttgttttctcctgtcagagcttttaatacacattgacaagaattattagtctctatctgcagttgttccaagtgcaggtttgaaataaggagtcgtcatcaatgtgctaacgcgtgctacttttggtatttatacaaagtgcctgctgccagttacttgccacttagaatgtgtttttcttttcctctcttgcgttgtgggagtagaaggattctctgtttcttttggcagacagagaaattttcagattggggtctaatgaaagaaataggttccattatacagatgtacagatgttctaaggtcacgatacctcctataatattcttatgtgaaacctcctctttatgttcaacctgtgtacgttacacttatacatagcaggcatagtagccatcaatattagttactttaaaacccaggcctcctaggctgtggtttgtactaaaacatcatattcaaataaaagcattccaatacaaagtggagaaacagggacaggcatggtggcttaagcctgtaatcccaacaggctttgggaggccgaggagggcagatcgcttaatcccaggaggtttagaccagcctggccaacatggcgaaacctgtctctactaaaaatacaaaacttagccgggcatggcggcacatgcctgtaatcccagctgtaatcccaggctgagttatgagaatcacttgaacatgggaggcggaggttgcagtgagccgagatcacgccgctgcactccagctttggtaagcctcggtaacagagtgagactctgtctcaaaaaaaagaaagaaaaaacgtgtagaaagaaagagaggatctgattaagctcacaggaacattgcttctcaaattttaatgtgcatacaaattgtctgggaatcttgttaaaatccagattatgagccagtgggtctaaaatgagacatgatgttctgcatttctaacaggtgatgctaatgctgctaatctgtggaccaaccacactttgagaaggaaggaagtagactattatatttactcattcacttgttccatgataactcttaaaacagactggtgactttaatacaattcagagcaccaaataaagattgtcatatgccttatttttaacctatcgtcttatatcaaaattatctgataaacttcccaagtgtgcatatatattgtcattttaaataggtttcaataaaatgaagattcgtgagtaagaatataggaataaatgacattaaaatctttctttataatttatatttctactttcttttgaaagaatttgtagtggcttaaacataagagcacaagatgagccagtgacaggaaaaaccaagtgcatctgacatcttagcttattaggtctagaagacaacctccattacttggtagcaagcggctgggaatattggtgttcaaagctgtgctttcctgaaggcaaaaacagcatcaaaatatgaaaagctttttacttctggcatgagtgataaagatgccgatctgagaagcaggtgaaaaaacttagcttatgcttctaaaggctaattttatataagtgttcttgtccagctgttcttggtaagtccagctgctagttgaacaggacaggtggtaatccctgttcagtggctcattatcacccagaggctttgatctggctaatacataatcaatcagcttctgaatattaatattcttcctattttcatttcacttgttttacctaaatttattttccaaagttccagtatgtttttgttttttaataagatttttgatcatttatttattttgacataactaggctcatgatatgccagctggagtttattacacccctgaatcacaaactttttttcttccctctttatctccttacaagatccaaattgcaaaacctaaggataaagttctaattttggaagcacaaaagactgaaactattttagaggagagcgttaatgaaaatcaatatctaaaatcctcattttaagactgtgaaccctatagtctatacttctagtgtcttcagagttgtgatatgcatacattaaggactaagaaacatttttttaaatagtcagatttgggagcattagatatgtttgtagagggaaaaatcaatttatgataaaaattactgacaatggtttaatttgtattagttttgcccacttccctgttatctcagaatggcacctccatggacagtggaatggtcctaacagcctaaatatggtaagctttaaaaacagatggcttggggccattctgcttattatatcattgctttcaatagcataactgttcttctccaatggccctctttgttgtttgcttcattactggcacatttctttaatatgtaatctataacattaacatgaaaatggctctcaaatactattactttctccatctgtgacccagtactgtttatcatcatctaatgatcattcttattgcagatggccctctttaaatgtttcagaatagcattttaaagacattgagggtgcttcctacgtacattggcagactgaatgttttaatatcgaaaatctcggtctacacgatgtgtgataaatgactggagatgcaaggcaccagtcagttccaaagcaaggtgtaagagggacaggaggagagtgataaaaaagaatacatactttgcgtgtgtgggtgtgggtgtgtgtgtgtgtgtgtgtgtgtgtgtgtgtgtgtgtttaagccattagatttatctttaaggaagcattatctttaaggaaagttggagtaggaagaacaaaatttaatcaaaagaaacagttcttggccagaggaggtggctaatgccggttatccgaacactttgggaggctgaggtgggagcattgcttgaggccagcagttcaagacctgcctagtcaaggtagcgagacaccccacctctgccaaaaaaaagaagaagaagaagaagaagaagaagaagaagaagaagaagaagaagaaacagttcgttattgcagttcttaaagaaggagtttgtgtttcctttctgatcattcaccatggcagtgatacaaaggagtgatatcaaattgataaatgagttccctaaggctcaacatatactaaatgcctatgctgaacttccaggtttcaagtccctagagcctctctgtctgaagatcctatcaccaaggattctttgtcttcatctagtactttctttctcctctctctattctttcctcatttgcggatgcttgctggggcctgtcaatcaaacatagatgatccctgacttacaatggttggatttaggatttttttacttgataatgctgcaaaagtgatacacattcagtagaaaccatacttcaggtatccacacaacccctctgtttttcactttcagtacagtattcaataaattacatgagctattcaatgctttagtataaaataggctttgtgttagatgattttgcccaactgtaggctaacgtaagtgttctgagtaagtttaaggtaggctaggctgagctatgatgttgagtagattaggtatgttaaatgcatttttgacttagaatattttcaacttatgatgagtttattggtacataacctcattgtaagttgaagagcatctgtatctgggttggagcagaagtattgctagtaatgcatccatgagtcaactgtttgcttaattggtatgctaccacacatgtcttgagcttgttcatcccatggcttgccattgtgttggaaaggaaggtgttacagcattgccgttaataacatttctaaatgggaccaaaaacagtattttctttatctgctagatctttttattttcttctttctctgtatacgtgagctgttcccaaaatttagcacacatgttttatgattctcaacataacgtttatggtccttaacattaatctcatattagaaaataaatcatgatgaaggtgaaatatagaccaagcaggggcagttatgaggaccaaatcgtcagtataaaacttttataattaatattttcatgaattgatagcacttgcttcagagagctaaactcagaaaaaagagaaatattctaacctgaaaatatatttttaaaaactcataatttaaggtagggggcaagtagatttggccatattttgggctttcttcaccaattcagacacgataatgactacatttgtatcctagatttaaatttgctagatggaaaagaaacacataaatataaaccccatctgcgcaaacaaacataaccattcacattcttatgcaggattctggggtaggggagggctttttttgtattataacatagcatgttaatttttaagataaaatggaaatatttttgtgcttttgttaatttttatgttaaaaatgacattttaggcacctaatcaaattctctgagttctttcactaaagaattttgcctaatatttgattaaattcattattattaaagatcaatggaatttctttcagtttgaaaagttgaaaaaatgagttgacacattgattcatagaaaaagttatgaaatttgagaaaaattattgaaccaattttatttaaaatacatatagatattatgtgtatctgccttcattttcaggataatgaatgtcagtgttaaatgtggaaacattctaaaattggaaatcagactccacttggttcaaagaacaccttattttagataagccttttaaaataatgattgaaatccagtcaatccataccctcacacataatcctcatgcatgatctttgtttttccctatctctcctctaaatgtcctttacaaagatgagaaatgttcttcccaacacaaaattcctttgattgtatattagaaagaactgacactttgcagcaaggtttaggaaaagctaacgtaagtagagcttctctgaaaactgttttaccaaaacatactggatttactgctgttaaataatggatttttttttttttactatttatatttgctcctcattgaaacttgtaaatgactttattagtcttaggcaacacatttcattttgcattggataaagatgcttcttcagtaaagtgttcatttatagcattgagaatcttgaaatataaccggtgtcatcaaagggtaggaaggtagaggcacagagaagtgattaatcacttttccctccaatgaatgatctactgtcaagttcaataatcatatttcatctataaagagcactttgagcaaagcctgttttgcacacgtcattacatttgattacaattaagtataaatatatgcctattatttagctctagttaaaatctgcaaaaatatagaaggcttgtgggtgatgtaaattggagatttgcataggtttagggtacaatattagaaaacactgtagttttatttttgctttatgactaaaaggcactagctatgttatctcgtttgttcaccaaactaaaaaacaacagctaaaaagcaatgtaacaaatttcctctaaccttcttaacccatccactgctgtcgcatgactctcacaaatcagaaataaagaaccatttctctactgaaggtcatcaactcatttgagggccatagatcagtaaaaaataacttagtctgagacattcaaatcacttgctttttaggtaaatattttggcttttaaaatgacacaaatctgaccaaaatgttactcagctttatgggaacgggattcttttctagataatcttagggacgatcttaactcatattgtttttgttcagagactaggtctaatttgttagaagtgctgccatgggatctcattctactcaacaggagtgcattcttcttatccagtatccactaaaagtcactcctcctcccatgaaaagagttgccagtggaaaactcagagaaaacatgggaagggattggtgatgtcatataaggagattagaaaacatttttttaacgtttaaaaagtaaagagatgaattttaaaatttacaaaccaataagtttgatgttgatgagcaacaaaatcctggaaaatgacatcgtactgattattaatgattacataggataacatgctgctgggaatcagcgtgatactctcaaaatctgccatgtcacatgcacctcattttcattttttttatggctgcttgatggttagatgagaagactgttagagacagcataacttaggattttacaccacatttttcaagttctcttttgagaatattgggtacaagataaagaacagtggggctggctaataggctgaatttgaagctgattaaataatgacatctaaagaatgtcaattaatagatctagatcaacacaaaatagagtctctgtcgttggccctgcctttgcacatggctgtttcttcttcagtcatctcttaagctcaactcagccctctgcctgaagacctcatttggccagttttgcccattcattactactgtgaactctcttttgttatttttttcctgttttattctgagaatggattgagctagatatgtggaagttatgggaaagcatattttaactaaatattaaagaaacttttgtaatcgagctctccaaaaaataaaatccgccactttgaaaagcattaaactccctgtacagtagattttcaagactgaaatgactgtctcacccctaaaggcaatttctgtattggatgagaggatataattcattaacctttaaggtcacttgtgaatctaatgttttgatattttcggaattaatcagaagggaactgacagcatgacctgaatctgtcctatatttatgtaaacatcctgtgtgatgcacctcattctttgtgcagttgtatgcatttttgaatgttaaatttgattttagggcaaacgcttttttaaaaaaattttaaaataaactttattaaataaaaatttacacacagtaaactgcctccatttaaagtggttcagcgatttttggcagatgtgtacttgtgaaaccaccactgcagtcaaatgacagaacgttcttactcccccaaaagcctccttgtgcccctttgcaggtcatttttcctttcacccctgattctaggcaaccactgatcgtctttctctcactgtgtattactttgcattttcaagaattttctataaatagaatcatacagtatttttgtatgtatctggtctcttatattcagcataatgattttgtttccagcttgaggatattatgaataagactgctaaaaattgtatacttgtttttctaaataccccttataaaatcttacttttgagaagcatattactaaaataacttcccaggttatatgtgtatttgttctttctgttcatttcagcattatcttattaacaagcaactggaggacatgcaccaaggataaattgactaggtgctaactgaatttgtgagaaaggcctagtttctaacgttctttcttgggagcagatgtgtaacagctacttttgctgtataacagaccaaccccaaaacttactggcttaacactgaggtcagcaaacattttctgtaaaggacaacatagtaaacactataggctttgtggagcactttgcatctttgttgcacattctttttctttttacaactctaaaaatgtagtcatacttagctgagaggctgtacagaagcaggccatagaccaaatttgaacaatagttcataaactctataacacaatggccagccatttacttagctcactatttgatgggtggattgggccatttatgtggtgtgaccagttgtactactgtttgccaggcatgcttatgcatctgtagtcagctggcagctggataagctatcgtgacctgactcatatgtctgatggttgacaggctgtcatctaggaacagatgcaactaggtttgtgtgtatctcatcatccaacatgctagttcaggctagttcacatggaaacttctcaggtttctgcttgtgtcatgtttggtagtgtccattagccgaagcaagtcatgtcatagggccatcccagatgtaaggagtggggaaagactccacctgttggtgggaagagatacaaaggcacactgcaagagctggacaccaaggagagggctagaacttttggccatgttgcaagatatcacaaaatattcaagaaaagttacaggaaggttcctctgtggactaaattctcttctgaatttagatgtaggtaaaatggagtgtgctgttaaaattcatgctttgtgagtaatcattgctaggctaaactgtttgtggcttcacagccaatggtagacatacagcatccataatctagtgcttttaaaaatataagaaatactgattacaaacatagttaaccacttattagtactgggaatttaatgaaagctgctgtgattaaatactgaaaaaagaaagattgtgggtttccttctggtaactttcaaagctggtcactcttttgaaaggaattttattcttaaagctgttatttttactcataatatgcttaatacccccatggctgcagactgtctaaaatgttcctacaattatatgagaatacttttaaaaatcatgataattatcagtcttcatggacacttattcagattaatttccccaagcacttaataggatgaatttataagcattaaatagaatggggaccatccagccctaaaatgtgaccattctgtcaggcacacacttgccaatttgttggcgtggacctgagcacactagcaaggactttgaattaggtctcactgcaagatggaagcagaagggcatttctcagtttatgttttgaagtgttttgttcagacaggcaacgtgcagttgtgtatagtagtgtgagctacctgttactccccttaacaatacttttagcagcaatgtttttcctcctgcaatgtgacaatatcaccatgccatttggaagaaaacaaaaaggctgagtgattcctggtatactcccaaacagccacccaaacgaacagctggcagagaagacaccccctaaaacttggagcagattctcagcccctgcagcatctcatgtggttagaacttcagacttgatgaacgcctccccaacttgctccccctcctgaatcttttaatcctcctccagtctcttgtaatgttccagcccttaccagggaataagactgcaaactgtcttccgtcaacttctttccaaatcctagtctagagaaattataatgatgcatgattgtccagtgggcatgtatagtttgtccatttctttatgtagtaaagcctgtagctttcatcttttttgccaatccactataaaaattaattttatatgtcatcctggtacacacacacacgcacacacgcatctatatctgtaaatctttttctgtctattcatgcttgtatgattgaaagaaaagtttcacaaaacattacttacccataccaaatagtacactttcatattttttttttttttttaatttcaacttctattttagatacaggaggtacatgtacaggtttgttacatgggaacattgcatgatgctaaggtgtggggctcatgacctgttacccagattgtgagcatagtacccaataggtagttttataacccattttccccactccaacctctacactgtcatattttctattcttttctgtttcattaagaacaatactggtaatgatccactatatagatttcatgacgtactaagggttcatgacctgcagtttgaaaaacactgtagttagttttatctccacctcaggccaggtcatcagaaagctgcattcttagaccactttgccttggcccccataagattgcctcaactcaggtgtacctcggcatcatgttcctggcttatgtcgaggggcactgaaaactgctgaagggatttttctgaaagtcgacaccatgcagtgtctcccaccttagatcccatgcagatctgtttattcaatctaagtcattccagacttggattttcctttgtttcacttacactctttcctccttatcaataatccaaataataaaatcgatcatatttccttttatattttttcttttgctttgacatctacaaaggccacaaccaaattatacccaccttttaaaacacttttttactgaaatatattaggcatgtagaaaataagggagatgctggttaaaggatatgaaacttcggttaggaggaataagttcaagagctctattgtacaccatggtgactataggtaatgaaaatctagtatagtcttgaaaattgctaagagagtagatttaagtattatcaccataagaaatgataagtatatgaggtaatgcatatgttacttagcttggtttagccattccacagtgtatacatatttcaaaacatgttatacatgataaagatatacaatttttatttgtcaattaaaaaaaaagaaaaaatggcttaaacttatacagttcagtgaattttcacaatctgaacacactcatttaaccagcatccaaataaagaaacagaacattaccaacctttagaaggccctttgtgtgcccttctgatagttacctgtcctccaagggtaaccacaatcttgattttgaacaccattaaatattctggcctgttcttgtcctttatataaatgaaattgcacagcatgtactcttttgtgtctgacttctttaaacctggattcatccatgctgttgtatgaagtggtggattgttcattctaattgctatgtaatatcccattgtgtcaatatcctgcagtatattatatactctactgtggatgggcatttggtagaaaaaaatgatgttataaacattctaagacatgccatttgatgaatatatgtatgcattcctttgaggactatatcaaggggtagaatttctgggttatagggtctgtgtgtgttcagcttctgtacattcttccaaacagttttccaatgtggttgtaccagtttgcactcctactaacagagcatgagagttgtagttgctccacatcctttctaaccctgtgttgtttgtcttgctcattctggtgggtatgcatagcaaaattttcataaccacatcatgcactgtgatcttcaaagctgtgttctggctgggcatggtggctcacacctgtaatccctacactttgggaggccaaggtgggctgatcactagaggtcaggagttcgacaccagcccggccaacatggtgaaaccccgtctctaccaaaaatacaaaaaaattagccgggcgtggtggcaggcacctgtaatcccagctacttgggaggctgaggcacgagaattgcttgaagctgggaggcagagtttgcagtgagccgagatcgtgccactgctctccgacctgggtgacagagtgagactccgtctcaaaacaaaaaacaaaaaacaaatctgtgttctaaattttcctcgcttcttaaagttttatgctatttatatttccttagtgctgggttttattaatttttaagagttatacattgttataagttgccctaaagcctttacagaacaatgcacagtataaatatgtacatagtatatacacaaatatgaatccatgaatgcacagctaatagggccattatcaaaaatcctacacttttccttttcctctagccctcacattcaattggctcaaaagtagcattgattttattctataacctgtcatgaattcagcctctccacaaattcccagtgctcctttcttagttcagactttcatccactcttaactgggctgttgtcatcatctacttggcatacatttccattctgatccctaccctcttttccacccttgtttcttcccacctcaaatttaattctattttaaaaagaaagatattcaaaagtacaggtggtgccaattttttcttctctatccatcatatgcaaagaggcttccaattctttgtcgacctgtttctaagggatgagagtaggtcaagctgtgaggacttcaattcccacgtgaaggtcttgttcatattaactcaataatgtgctttgatgtcctaatggggaaagtagtattttctgccagttagccttcccaagatatcaaatccaatattggccaaatacatttttgaattcctaaaaagcctaaactgatgtcgtaacacagctgtatattaacataaaaactctgtaccttagtaaattattaatatgagcgattagctcacagagtcaatgtaagaaacttgtttcaactcttcatattctagcaaaaagaacacacacacacacacacacacacacacacacacacacacacaaaacctgatttaagaactaactaggtgattaaagcctacttagtttttaattgaagtgcatattctctaatcccaagaggccaaactaatcacctttccctttttgctgctttttttctctctatttctgtaattattataatctgtctgatactgtgtttagctatatatgggtctatcttctctcattagatcataagctccttaaggaaaaggccatatttccttgggatcccacttaaaaaaaaactggattacaatgttgaaatttttatatatttccatgtcattctccaaacactccccagtttttaccaaccataaagaaaaaatgagaagagtttaaatgataagcaaatacatatgtaagtgttccataaatacactatgtttgaagttatttaaagaacttaatataggataatatttaatagagaaacttagtctagatagagcacataaaaaacattcttggaaatttgtggataaataaaagttccttgcatctgtattttcctttcatcttgaaaacatgccttgacaaaagtaagccagagctggagtacaagattcagacattggtagatcattaattggttaaactggattttatcttatttccccttttatggatccctgtctttgtgtggaattcctgccacttgctggctgttcaaggcttgccaccaggagactttctccatcaagctaggggatatttctccctcactgtcccccaccaaatcaatattcacttgctctctgactactccaggtttctgctgtctgagaatatgaacatggatataccttttaacatgcgtgaatactattcatattttaatctcggccccactgaatgatagcaaacgctgtgaattttatgcctatctcaggctacagctagtgccttatcttgcacacacacaaaaaaaatcttacttttcctacttgcttccttcttaagtgtaaaaagcaaaaagaggaaaggtgccttttgtaaactgctaaagagcagtttacagaagagcagtttactaaactcagacctctcattttccctcacacgacaatctaaaacagaatgttaaagtgaatttatttggttctgtatacctaactattcctgaacatactgagttctcttttaagaaatcatacctgcctgacaggctgctttgcatgaacacagcattccccagccttcaaattgctgtcagagccgttgtgtcattttgacccacaatatggcagtattatccacattctatagatgagttaacaaaagcttccaagtggttaagtgacttgcctgtaaagggttaagtgacccacctctaaggggtagaattggtctggacactctgcccctctatcttcatgcctttgctataatacacagctacgcttgctgaagattaaggaagctgcttttgataaagcgtgattcttgtagatattcatctcaggaaaaaaaaaaagaaaaacgctggtgtcttcatctgtagcatttgattattacattttccttatctgtttcaacttaggatgacttccttgttcgcttaattgactggtaattcctttgtttacttttttccaaatctcaagaagcaagtctagagtattaacaatggttacattagcatttaaaatttttttttgaaatttgagtatttcagaaaggggtaatttaggcaggcatgtatgtagaactttgcattttaattaaaaagactcaaaatgaaatgaacctctgacagtaacagatgactacttctaaaagctgcattactacttgatatatgctcagtattttcttgtgggtaagtcctacgacttgtttcaagaaaagtgacaggactaaaacaattaaaaaagacaaagctgctgttttttaatcatatgttcataaataaaactaggttgtgaattgtttccagagaagcaattgacaaagtatgagtaaatcactctaagaactaaagctgcgttgattttttttaatgttcaaccaaacatctatccttgtccaatgatgaattttctttgacaaataaatatttacaaagtatgaaatatagactctgtgcctttcctaaggccaaagcatactgtttaaactaaaatttaattttttttctcacctcaaatacaccaaaataagaacataactaaaaattaattctctcttgtagtagactgtccattaatcttttgttagataatattagcattgtgagtgtcaggtagaaagaaaaactgtaatttctagattgatcagaaaatgtgagtatttatggatttgaagaaaacaataaagtctgataaaatagaattttctgtaacctcccttatggagtcaagaaggaggaatctttcaacatcctcccattttgcagtgaaaagtcttcatgcagtaaatagtttgcttgggtagatcaaagggttaatttacttctgatttgagaagagacgcagacttccctgatttttttacaaaaatgtgttgtgtgggaggaaggtagaggcctcagaatgaattcactaattggggttttcacctgctgtgagtctaatcgaatacaaagccttatttgtagctgaagaggaagagagattatgcagagtgtaagaatttctgcccagttttgaaattccgcttatttggcacaatcggtggggaaaggcagacaaatagttacaagtttgagctgttaaggtagaccaggaatgctgtagtcagatatacttgaaccacattaaccagtgatccatttttagcaggaggtggtgtgggtcatatacatgggttatcgctatagctggcaggctaataggtactccaaattctttcccatgaagcaaccgtcggcctgtgaggttaatgaagtatggctttattttagtgaagatgctaaaattcacatctttttagatgttcggcttgatataggtggctctgtgaagctttgagaaatcttattaaaagaaaactgtgtgagagtgaagcagagctcgactttatctggaacctgtctggtgaaatctctggtttagatggcagctggctcacagagaactttcctgagtctggcttactctgcctccctaaagagacagggcctggaaaaataggcttttgtgtgggtgtgaagtgctctgtgtctgaacttagaggcctcttcatttgctggttaatgtgacctggctggatattcttacatccagaagatgttggtttcagattgatctagggggattgttatatatatatttcaattagtatgctataatatttgccctaaccagcaatgattcaccatacaccaacccatttgttagatgtctgagtcactgttcatggttagtacttgtactatgcaaagaggaatatggaattcttatgtctttattgtatacccaaatgctgacattttactatagaatatgtattcgagttaattgaagtgatacctatactctaaatgaatttttataaagtgatgcaggttatactaaaacttagggcgcactatagatagagagaagctgaaccctaggagttggtgaagtctctcgggaccatccctccaggcaagtacccagttcaaaccattccttgtctttgtcctttcctatgccactctgcatttttacacagctagcatcaggccaacattgaaaccacatgcaacccagaaaggaaaaagatgtgtttgtggaaggtaggaacagcctagtttcagctgttggcccttcacagcctccactagatgggctcattcgaacccaagacccttccaacagtacactgcaaatccatagctccaattcagacatcttccctctgagctcaagactcagatgtccaactgtctcttggatacctgcacttttacatcaccacctccaattcattatgttcaagactggattcatcatctctttcctaaccctcttctgccccctcctcctgaaattcctagctcggagaatgctactcatccaatctttgttgtcactcaaggacaatggtccttaaccttcactgcatattagaatcacttggagagtcttagaaatcctaatgtccaagaccaattaaattagaatctcagggtggtgagacccaaacatctaaatttattaacaatccctgagtgattccaaagggcggccaagcttgaggactattgctttacttcttccctctcttccattcatacatccagtcagtcaagactcctgtagttggaaccttattgtatcatttctccacctcctctgccactgctgtaattcagatcctcctcatactgcaatctccttgtacctgatgtctgaatttcagactcttgtcttctgatcaagcccccataccattgcctgagtgatttttctaaaagacaaaccggacagagccacactcatgctttaattctttcttccttaaaaagctccctcatacctttcaggatacaagtcaaactccagattgtcacactaagccctttccagtttgcccatttctctaacccttatcttgacattctctccaaaagatcaagcagaccgttgaagctcttgtaaagaacaagctggttgcatcctttttaccctcacatctgctgttgtcaccatcataattgttgatatgcctttaccctcaaaaggccagaagctctttgtgggcctacagaggaggcttctctgaatatttatccaatgactgagtctcatctgctttttagccccagagtggggggatctgactttctcctctatcagtagtccccactcagcatcaagtctattgccccagagggtggctttggctggatgggtctcagtttggtcagggtcctgggagaaacagatggtacattcaaacggaacacttgaagagagtataatgaaaaggctatttacaaggctctaggcaggctaggagaaaaaaaaaaaaacaaggaatggtaaacttttgcccaaagggataaagggaggaatggtttgcgtaactggtggaatgctattgctgtaggaaaggactggccaacaagacttgtggctgcaggtcaaggaactcagcagctgccaggccagagatcagtaggagggaacctgaagaataaatacccaaacatcaccttcctcctgtcctttcctctccttctgtaggcctttcatcactgcctcccaattggctgaaagcaaaaggaagccaaacggcaggaaagcctgattgatgtccccacagaggtccaacctcctgggccacagagcagaatggagaaggacaaagaatagagatggatgggagaatggggaagcatcctgcacagtcccttaggtcagagatgcccttattctctaaagataccctcaaagtttaagtggttcaaagaccagagttttggctacgggaaaatgtactgggtcgccttctttgacctcatcccatttcatttcttctttatctctatttctagcaaatttactcttctctgctctgagccatcagtgagattgtctatgagtatactagaaaaaacacagacctttctcacaggaaaagaagccatgtctcttcatggcagcatagcagaatagctaagcgcatgagtcttcgagctggattccccaattccaatccttgcaccattctagacagtggtactgggaacaagtaggtcatggctgattctgaagtcaaaattttagctgaagtttgttctggtagcagagcttcaggctcttttcatgtccgtggttcatatcaaaacagtaataataataataataatataatcagaaggaggagaagaagaaacatctactataaacaaacaatatattatcatacatggcatcactacataatttacatatgacacgaaggtatatcaattatgttcttttccaaatgctttcctctaataagcaaaattcataatctgactgcaattgaacaacaaaacagtctctgtgatgcccgcgtcatttcttaatactttcagtatttaattataatatgacgtcaagatttgggaacaagtcttcaagtgcctataactccagtctaaaaaagaacttaaagatgtatttttgaggattgccatctgtcaatttttttaaaaagtctgaatagtgatttcttattccattcttttttcttgtcaacagattattcttagtagttttctaattggacactgagaaaagagacttaagcatttatagagaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcttttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgctatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagggggtggggatttttgtttgtttgggcttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataaactgtttttacatcatgaaaaaaatccatccgatttaagtggtgaacttttaagtggcgtctttaagtgaaatctacatttttccttgggcaataaactcttcttggtcttctgctttatccctgtcatctctccttgtcacccaccccccccccccccacacccccaatcaacctttctttttttgcctagcttttttattgccttttactcaagcccctctttggaggatacatttgctgttggagaagcgagtggagcaaatgaagcaacacggttatatgaaaggtctctgacccttgaacaccgtggaattggtttcagtcatcattgtttgatctccgattggacacgaccctgaaaagaaattgctttgaccaaagttgagggtgggtaggagttaaaccttgaaaagcaaataaaacggaggacaactaacagctggaacagccaccgaggcaatcatctttgccctggctttagccagacagaataaaatggtaaatatcccagggaacaagaaatggggaactagaatggatttctgatgcttatattgatgcccacccctccaaacccctgccccacggtagcagaaactttaaaatatattttaccatccacaccctgccagtattccagcaatgcaagccaagttcaacaattcagcacgcaaatgccaaggttcctctagaaaaagagtctgatcctcagattaaagggaaatcatttgtgtgtgtggatcaatgggctccagattatatatgaaaccaaactctaatcctctgcaaatcgcaagagaacgctccctttttatattgctgcatagcgattagttttctccctgggaagtagtggacagatagttttttaaaaaggcaactgtttggaatattttcagtaccaaataacaatggtggcagaagaaatcttattttaattaggcaactgccattttcccagccacagcagtagatatttgttactttttataagtgtttaatgtttgtttttaagaaactaaaaaagcaattccaataagtctgattattccagcactgacagcaggaacagctctgaggcagttataataaccttgcacactacttgaaactaaagcaggtgagagaaaatttaaattgtatggtaggaaattaggtcagccttgtgctcagtagagtaatgctttaatttcttattattgacaagtaggtgttgctggggtcttttgtcatagtcgatgactttatattttaatttgcatcagggtcctatcaccgcctcaaataaaagggaaaaagattatcatggtttgtagaaagaagaaggagaggggaaatcttcgtataaatactgctcagagaggcatatctgatgccaggctttggaaccagcagggccaaaatcaataacattttttaaagatgtaaagagcgttttaaggattatttatgaagctgatctctgtgttaatgtacgtacagacttgtgatctatgttgaacattgttgttctcagaaaggccaaacaaagatgtacccattaacatgtgaacaggtttcagaatttcccttttggttgttcatggtatatggggagtgtatttccgatgtggagagtgaaatgcagaaaagagacaattaccaaaacagtgccacccacccttccactccctcctccctagcacaccgtgtttttctatatcgtctgcatattccaggtaaatgtgggctcttctcatggagttactgagaattctctactgttttagaaggcaggcacagagtaagaaacgaagctgtaaaatcggtattgatcacagacaaaaatgtggtttgtccttcaaggtacaagatagatatgagttatgcagatttgtgcttacagtttcatccagtccatattcatagttcctatctattttggagggttaaatgtgtcccagtggggctctggattcatcacaggtagaaaataacaagccgtgaagtgaatatttggttcgtcatatagttaccaaagaatctgaaggttttttggctacgttgccaagcatttttagcattaaatgattaaaagactatttttctcgttttaagaattagtcacaccctttattcttttcttctttccacttgtgctcacttcttttgcttagaactgatttgcaattgaagtgaaactaagactgcaaaggtgaaatctaaatctgtttttctagttcttttgcattgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaacagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcaggcttgctttaaatttcaccgccagtagggcgcagagccctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaatggttttattaaacatttttctaattataaatgattaaatgtcttctagaaaacctgaaaaatgtaaataaaaaacatgaaaaaggaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaatagtctaggatcttcaaaaatgtctttctatacatatatttttatagaagttgaatcattctgtcttataacttgctttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcacctttcagagttaatatttccaatagttttgtaacaatcaaacattcgttgggcttttatccaagtggtgattcatcagataacatctcccatttattgcgggcctattgtatgttttccacatgggatgtgccagcaaccaacctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggctcaagcgatcctcccaccttggcctcccacagctctgagatcccaagggtgagccactgcacctggccttcacaatttccaatgtcaaatcttactacaaatttaagtaatcaagagtatttacatatggacagatatactgaccaacagagtagaatttaggctgggcacagtggctcacatttgtaatcctagcacttttggaggccgaggcgagcagctcacttgagctcaggagttcaagaccagcctgggcaacgtggtgaaaccccgtctccccatctctacaaaaaatacaaaaattagccgagcatggtggcatgtgcctgtagtcccagatactcaggaggctgaggtgggagggtcgcttgagcccgggaggacgagactgcagtgagccgaggttacatcactgcactccagcctgggcaacagaacgagaccctgtttaaaaacattatttcttagcctgtcttattgggggggggtctcttaattataaatacaataaaatatgtggttccccaatggttcctttttaaattacaatgtgagtttttttgcatttgtgatactgtcagtatagtacaagaagaccagtttatgaaggagacatgtaggtaaaaataggataatgtgaagagagaatcgctgcacttcagaaagctgattttatttcaagcagtttattaaaatctagatgcaccgtatgttctggtgttacttattccaatttccttttccttcattgaagccctcttaaccacaagtgttttctcaaggggtactggttttccttttcttaagttatagcgttcttcagaaggatctagccctttttaatctgttgcccaatttttggatcctactatccagcatgatgctcacctgaatgatgcgaaagctctcaattttcaaaaatggacttctgagtgtttttggaattcttaggaaaagtggtctttaaaaaccataagatttgaaggcagtctatcagcacgtagcccttagcttcatgtctatggtttgcagagagcttcagaatgttaaaatgagggtttaattttagggtctgctgggcctgaggttaggggtgtgattcttcagcagttctagttaggagaactagttaagtcctagttaagtcaatggggctaaaagctttttaaagatacatcaatatcattataaatcagcaatttgcaagagagttaaaaacactgctatcaaaatccttgtacctctttcctcagcttgcccaagaggaagggatattgtagttatttgttcactctcctcttttgataggctttctacattccattaagtattccctcctgaggatgctcttgggttagaaactgcaggattctgaatgactatgaattccttccttttgcattaggagcttgtcctaatgcttttctcagcatattttgtgaactaaactgttctccactaagctactcaatatttagctttccttggctcttgcttctagttccttaatatattgctcagtgttaaaacctctgccttttgactttttactgccataacgctttgaactggaaaggatagctagattcagatgccagctttggtgtgacctcgggcaagtcccttgctttctattggtcttcattttcttatatgtcatgttggccagtgatctttcatcattaaatgactggttttgttttaacccctggctagagtaaagcttggttgtatgaatgttgtcagccctaaacccccagttcctctttgtcaccaccaacctaaaggatatgaataataggataatcatatttattaatttaattttttttttttgagacggagtctcactctgtcgccaggctggagtgcagttgcacgatctcatctcactgcaacctccaccgcccgcgttcaagcgattctcctgcctcagcagcctcccgccaccatgctcagctaatttttgtatttttagtagagacggggtttcaccatgttggccaggatggtctcgatctcttgacctcatgatccacccgcctcggcctcccagagtgctgagattacaggcgtgagccaccgctcctagcctataatcatatttgtaataattgtactttatttgtgtagcactttacaatggcgaagagttttcagaaataaccatatttaatcctcacacagctatagagtaggtggcatatgacctggattttctatcaatttcagtttcagattttttgtcctgtcatccctttgagtgtccttccagtttttgatttgggaaataatgctaccataccggtggatggggcaacttttcccttctttccatttggacttgagcagactgagactcaagacttgatttgatttatactcactatggtagaagataaggaaccaagtccagaacacacattttacaaactccgagttctctgttctcaaaggaacatccattactcttagcatgatttataaaactgctttatcggcataattaaactggaatccatatgacattctttattccctagctgacaaaattagcacaggagatttactcaaatttgttattaaggctgttataaatgttcttcctttactattcagcttataaaagaaaaaagaaaaataatctgctcttttaactttgattaggatccattgactttccccatttgtaaaatagaaatgtaacttccaaatcaaaatttatggcattttaatggactgttctaaatattataatattttttcttgttcaaataacttgatttaaagcttctaattgaagaacataatagatatttctgaattgcatctctccaagcttatttcagaaggaaactcaaaaagaattgttccttagactttgactggtttacagttttaaaagagctgccaaattgtagtttactgatctaaataagaggaacattaaggttacacctgcagctagaagaaaagtgctggatatgtacaattttatgtagctggatctgcagaagatgatttttgcacacagagtaaaggcatctaaaaacgtgtctgctcttattcagacatttccaatatttcttttttaagcccacaagtctgattacctctgtatgtctcttgggagctgcaattttgctggaaagagattcagaacagtcagagcactcacataaaatagatagtttttaaagtctgtaccctctacggtagtaataaaatgacctaaaaatattctgaaagtctctcttatgacatagtggatgaatcattagcttatttatgaattggtgatattctgtgggaatgtttcaaaatttgctattccacaaagcgttcatcgcttgcataactccaggaaagtcattacaccccctcataaatagaagcttatataacggagacaaatgttgcttatattgatatatttacatacagatttctttaccaagcattaattttggtaagaaagtgattgtttttatattttactttcttggtctgtaaagaggctatcactttaaggccaggcatggtggcacgcacctgtagtcccagcgcttccagaggctgaggcagaaggatcccttgagcccaggaatttgagtccagcctgggcaatatagcaagacgttgtcttagaaaaaaaaaaaaagaagctatcactgaagagcagtgcttctcaaactggtgaagggccaggtttttgttggtggtgggtttttttttttgtttttttgagacagagtcttgctctgttgccaggctggagtgcagtggtgcgattttagctcactgcaaactctgcctcccgggttcaagcgattttcctgcctcagcctcccgagtagctgggattacaggtgtgcaccaccacacccagctaatttttgcatttttagtagagacggggtttcaccatgttggctaggatggtctcgatctcttgacctcatgatctgccagcctccgcctcccaaactgctgggattacaggcgtgaaccactgcacccagccgcggtggtggtttttaacatactacacatcacagatttttaggtggtgctaatgaaactgacaagtatgcattcacaccacatgtaactcaacagtcaagttcaacaacacttgacctcgtctgtaccctgctccatgagatgaattcattgatcatgaatttggatgtcatggcaatgtcaaattgctatagaagttacttaacacactgtccatatctatgcttgtgaaagaccatattttgagtagcactgttctagagcacttaatttttgaaagtataaatgtaaactcaaatcaagtgactcaggtcgggggaggataattaaccaaacaggaacacctgaaaatgttatttatgcggtttaatgttttgccagttgagtcaagttcaggcagaggagggatctattttctttcccacttggtagctctccttagcaattgttttagaagacaaagcatagaaatcattgtgttacaggaaggaaccagagattaagcggcagagccactgctgcctagtttaatgtctctcgcaccccctataattaaatataatgtatataatgtgataagtttaaaatacaggtttgcttttatctagaatataaactgtgatatatgcactctttatggggtgcattcagtgggggaactaattgattatactgtgactttcctattgtcactttatgagtttaggtttggaggcaatgttttgcagcaacaaaattgttcattgactttgaggctggatttaaattctgattctgtcaccagttctctgtggtcaaaaaggaagccactaataattttaaacctcagttatgtgatgtattaaatagttatgatgagacttatcttgtgttgtgaggattagaatgacatatgtaaggtaacagaatgtctgatgtagtaactgctcaaggaattataattgctattagtgatatgcattattattattagttattattatcatataccagtgtctctccttatttaataatctattgggttcctgaattgagataccaagaattcagatagtgagagacacctaggtttaggtcttcacatttgacactcaaggagccactaaatttttctgaagtattttacttcttaaccaaggtgataaagatcacctgatcacaatttatcctaacttttggaaagcatacacgtactttaatttgacatgcaaattaaaataatacattttgtactgtgttgtttgccctcccccaattctaaaataatatatcattcaggataaaaaagactacactttgggaggccgaggcaggtggatcacctgaggtcaggagttcgagaccagcctgggcaacacggtgaaaccccatctctactaaaataaaaatttaaaaaagccagaagtggtggcgtctgcctgtagtaccagatactcgggaagctgaggcaggagaattgcttgaacctgggaggcacgggttgcagtgagccaagatcgcaccactgcacttcagcctgggcaacagagtgagactctgtctcaaaaaagagcataaatatctaataaatgatggtggtactagtctgtggtagtggaggtatcacagaatggctgtagagatgaggagggctaaaactgtgaaaagccttatatggtatgttgaaggttttttatactaaggtttttgatttggaagatgtatcaatcagggtctgcctggtcagaaaacataaaccctctagttatttcaaacaaagggaatttaatgcgggaaattggttactcaagaatggaagtgctgagaagccacacacacagcatgaagtttctgttatacctagggctggagggacaatgacaagaggtggtatcaccagagccccagatgtcatgggcatcaaggcggagttggaacctttggccagctgggaccaatgagggaggggctccgagggagctggagccaggaaggagacacagttagccagacctattgccggaggtagaatgaaaaaggaagtacgcccggcttctcctttccgcctgccctctaggcttctgccagtgactcctattggccaaacttacttggaagccaattggtaagggagcaggaaaatgtactgtaataaacagcagagcagagaaaaggcagagaaagtatcaaaaaccaacaagcaaatgattgaagtacaggagatcccatggacagtaaggcaaccaaccctctatgcagatatttcgggaacaagaaacataaaaaaactaaaaagctttcataggagtttgaggtgacatagataagataccagaaggacatcctgggttcaaaggaaactgatcttaaaggagaggaggtagcaattaaaacaaattatctgcagagaagtccaaacactaaggataagcttccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgctggaaaaatgtccatagacatgctcaacacaggattgccacaaaccttcagtttgtaaacaatgcaattttcacaaagtgcaatacagcaaagtgcaatttaatgagatgagcctgtaatgagcctctttaaagcaggaactgtcttcctcatctttgtcaccagtgcctggtgcatggtagcctctgaaaaaataattgttcattgaatgaagcacagtagagcaagggagagtgattttgctcgggaggaaaacaaataccactcaagaagatggaaagatacagatgagggttttctaaggcggattattaaactggcaagatggaactctggagagatggagttctttccagaaagtagaagataaagcctcaaagtaattaaaatagggaatatcagttaagttgtagattttattggcaatttgttatcttagcaaaaccaagtgaactgctattctggaattaattttgccctaaaaggaataattaattgataaggagaaataagacccgtaaaaagtgtcactatggattcagaatttatatgacaaagaaaggaaacactgaacacaatttgatgtgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaattttctttaccaaatatgtatggtgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgctgccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacaggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcggagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttcattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactgtcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaggagaatagtattgtttattccagcagccagagtggcctgtgtgactgtaagtcgcctgtcaagagggagactgcaaggaaagtgcattgatttgatttggagtagttgtaactgcagcatgaagaatatgatatatagggatgataattgaggaacaatttaatggctgcataccttgctgaagttgaagttccttctggagataaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattaagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctccacctcctgggttcaagcaattatcctgcttcagcctcctgagtagctaggattacaggtgtgcaccaccatgcctggctaatttttttgtgtttttaatagagacggggtttcaccatgttggccaggctgctctcgaactcctgacctcgtgatccgcccgcctcgacctccataagtgctgggattacaggtgtgagccaccacacctggccctctccttcatttcttagaagagttttacaaagtcattggtgataaataagtaataccatttcacatctggaaacataacttgatagtaattataaattcacagactgtactttctgtacttatctaagtatgaatgcataattcctgtttatctgtgtgtaggtttatttttcccccatttaagtaaagctctatgttgatgatgaggtttttacgagttgagattttaagaggcctcaaatatatctaaaaaattatagaccaagtatgatgtgttagtgttcctcttctctcagctaattctttaaagatatgttccagaattcctggtctgttcttgaagatctcccaataattctagacttctgaagcctggatattttggcttaatttgctttcaagacagactggatttaaattactcaatttgtctgaagtctcattaagatccaaggttcttgtctgttctagtgagtttgagctggcaagaataatacttgtcatctgaaaagtccattagaatcctttggaggagtgagactggaaaattggagacatattattatattttaaaatatgccacctttctataataggagtatgtggggagactgccttgttttggcttcttgggaaaatttggaaaattagtaaaataggcaggcagtagtagttcaatgcgtattgtatgccaaacactgaatttagaacaatactcccccaaaagcatatgtgctctaaattttatttttcacttaccacctgggagatttggattaaatttcttctgggaaatagagttggtatgaagaaacaaagaccactataccaatttatctgttggaataatcatttagccgtacagctctttccactcataaagttaatgaggtcattattgttctttctagctaatagataggcatattgaaaccttaggcctttccaaaaagtctccataagccattggaaagatagactaaaacactccttgttttaaattctagacctcagttcagtcagagatagtaggatttttgcagtattattaaaaagacagaaaccagctataaaattgaaatgaagggacttaatgttttttttctgtaatatctttggaatgcttccatggctttaaaatgctgaggtgtttctcactatttttcaaaagcatgtaacatgtagatatgtgacgcaaacttgaccagttgttcctcttttctggtgaattttgacacctgctactattacacagagtaaaagtgaaagtcataaaacagaaatacttaccaaagtcaagaaaaatgcatagactaaacaaaggggcaagagaagcctattacttgtttcatgtttcaaaataaaagatgaatggcctatcacttcagtagttggaaattcaacttgagaaggtaggtggtttgatgtttgcccttgttccttacgtttctagatttctctatttataggctagaaccagccctggataaaataatacaagttatgaagagaaatgtgcagttcagcatttttacccttctgaagtgcgctttctcccagctgccatggaaacatggcgtaactggtttcttggatagtctcactcctcttgagttccggctgtgagagctagtgagctcattacaacttggatcagagtcctggaaagtcagctcccagggaaagtggaggacagtctctcatggggcacgggaatggggggctttagctttattaaactgcatacatactttcactacacagtcatcccaagctttagcccaggacagtgtcacattgttcacagctgtattgcatcttgaggtttctgtgtgcatcctacacactttcctaaggcagagacttatctcttccagctgtaagccggagggagtggtgctgcagactcctagcaacacatgcggactcaaacaacacaggcagttaactctcttgagtagtagacttgtagggcaccagaactccgttgcagttcactgacagttaccagatatacatttgtatggcttccgtagcattgtgatggaagctaaacgtttgccctgctactttcttttttttttttttttatttttttattttttttttattatactttaagttttagggtacatgtgcacattgtgcaggttagttacatatgtatacatgtgccatgctggtgcgctgcacccactaactcgtcatctagcattaggtatatcacccagtgctatcccccccactccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcattgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctgcatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccacccttggagttcactcctgattaagacaactgaccacctctacagtgtagcttaagctaacacacacatacatcagagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgttttctttcccctagttgaaattcaggcttttatgtttggtctctgcgatggccataaagctgaaaatgttgacccaagtgacttggatatggattgaattattgccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctaggtggcgtgagtcagggcttgatagaccggtgactgcagaaaccacagtaacatatattgttgttattctgtgctgaacattagaatgattgtaccttagaatatagagccaaatgtttattttattcctaattatatttttaaatacatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgtttttttttgagacagagtctcgctctgtcaccctggctggagtgcagtggcgcgttctaggctcactgcagactccacctcccgggttcacgccattctcctggctcagcctccggagtagctgggactacaggcacccaccaccacgcctggctaattttgtttttgtaattttagtagaggcggggtttcaccgtgttagccaggatggtctcgatctcctgaccttgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatctaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccacagtggaagaagaattgtcttggaccccacataaaatacactaacgctaacggtagctgatgagctaaaaaaaaaaaaaaaaaaaaaaaaatcgcaaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagaaatgtgttgttaggcaactttgttgttatgtcaatataggagagtactacacaaacttagatggtatagcctagtacacacctaggctgtatgggatagcctattgctcctaggctatacacctgtacagcacgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggtgttctcagagaatacgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacgcttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaactttgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactgtcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttctcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaagaaaaaagaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccaaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttggatttttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctgcaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctagatatcctgccataacacccagagtgagtctccatatctctggtctcagttgtctcaactgcaaaatgattttaaagcaaccttctggctctaagagtctatcactctgtaaaagacaaaaaaaatctgtcttacataggaaggaatagcaagagttagctactgtggcatacatagaaaggaaaagaatgagcttttgaagctagaaggttgagaagatgattaggcacaaccagagcctcaggaaccattagtgggatccctgtgttgaagtcctgcctgctcgccgccccccaaccgccactgtctgcttttcctgcacagcaaagaggatcctggagagtcagccatttcttttatcctgtccccaccctctctcacccccacagccctcatgcatagggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacacacatatatatatatatatatataatatatttaatggaaattcctagcttaaggaaacaatggtttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaagacctgagttgctgtataaagtggatttgttaaattttgatctaccttttcttaagagggagaaagataagaaaattttccagtgataggaatttgtttagtccattagtgcccaggatttctttttgactgagggatttaataaattttagtagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttcttaatttatgtagaacttttgcagttcaaataagggtttttaggaattgaaacttggtaaacattcagtggtcaagttggttgaatttccattgcattgtaggtcatcagtcaaagagataatgaatttggaaaagttcaaaacaatcttaataaaacagtggtcaatagagttcacacatcattgagcactttactcctttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatattaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagttgcagtctcgctctgtcacccaggctggagtgcagtggtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttagttggatagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcgttttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattacttttttttttttttttttttttttttttttttttttttttttttttttgagacagagtctcgctctgttgccaggctggagtccagtggtgccatctcggcacactgcaacctccacctcccaggttcaagtgattctcctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcacacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctgtccccttctccttccctccttccttcctttcttccttccatttctatcacccctaaaattccatcatgctgtatcatctcactaagtcccaatctctggaaaccacagctctgttttctgttcctgtaattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcaatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcagtccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacataaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctataagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacatgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcaccccctccccgccctccccctcccccccccccccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgtttattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgagcttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgttccaccatataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagaccgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatagagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactcccttttggctcattttctggtttaataaatgtctcttttagtgtatattttttaagatttctggttattgtaagttcttgtgcttatgcatgctgtgataggcgccactgatattaataagaaaaataacatggaattatccttgaggcaaagaattaaagctctgtataagattttctgtataaaatggtattaaagtattttggatttatatgcctacttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagtttcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgatccaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctatgatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttccgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcctaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttacttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagttttcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaagactttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctactgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctggtaaatcaaggcgataatttcaaagataaaaatctgtatttttagctttagcagtgagcatgattcccagtctttttgccttcgagtaaggtttgtttccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaagtagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtcagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccactcaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcactttcccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagggctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcgggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatgattgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgtaaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgtta

SEQ ID NO: 4463 - DNA, 1036241 bp, human; identical to SEQ ID NO: 4458
